United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 17

SEQ ID NO: 18782 - DNA, 8760 bp, Homo sapiens
tcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgtttgcctttatatatgtttgaaaatgacaatagaaagggttttatcaccctttgaatgagacagagtggctatactccacagagctcagctgagttcacattactaatatttatgaaagaattttacaaccaaataattcctgtggtgtgtgacatatctcatccactctactcatttattaatgttattatacagtggtggaaacacatgacattttacatcaagtaatagatttaatattttctagtaaataggcgctcttccaccagaaagtataaaaccatcatatacatatatatatatatatataatggtttttctccttcatgaaaatgacaagtaaaaagcaaatctgattgaggataccttaagctggctagaagtgtttgaatcacagaacaatggaattagcaaaatcctttttatagttgatggaactgaatccaggggcatatgacttgcccaaggctaccttagccattgtgggacccagaaatatctcctgcttcccattgttcctccttttcacattgtttttgcttcagaacatttgatgctctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttcttg

SEQ ID NO: 18783 - DNA, 11263 bp, Homo sapiens
ccttaaatttccttgcagctgatcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgtttgcctttatatatgtttgaaaatgacaatagaaagggttttatcaccctttgaatgagacagagtggctatactccacagagctcagctgagttcacattactaatatttatgaaagaattttacaaccaaataattcctgtggtgtgtgacatatctcatccactctactcatttattaatgttattatacagtggtggaaacacatgacattttacatcaagtaatagatttaatattttctagtaaataggcgctcttccaccagaaagtataaaaccatcatatacatatatatatatatatataatggtttttctccttcatgaaaatgacaagtaaaaagcaaatctgattgaggataccttaagctggctagaagtgtttgaatcacagaacaatggaattagcaaaatcctttttatagttgatggaactgaatccaggggcatatgacttgcccaaggctaccttagccattgtgggacccagaaatatctcctgcttcccattgttcctccttttcacattgtttttgcttcagaacatttgatgctctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttcttggttatgtctttttttatgaatccatattcacacattaggagttcacttgaaggctattcatgctctagtatattaatcctaatatttagtaattctaaaatgaaatttaaatttctgatttggctcaatgttatatttcatacatagagtaaatttatttccaaatataccatcagtattttgaattatgtagataatatatccgttgtgttagacctattactcttataagattgaagttactgacacaagaaaaacacttctattttaataaaagaatacttaaaattttgagagaatgcttactagtttctcttgtgcctcagaaatcctgaggcatattctaagatgcattattagaagtttctctttcccagttattcatgtctatcctgcatccctagtgtaacatatgaaaccagtgttgtttatttcatactttccagatgggcatcaatcatttcataacaatgagatgcatgaatttttccattaaaatgttttctctcacttaaaattggttatcttcaacaaatggcacagtaataaaaggatgatcatttttgttctttaagaaagtaaatgtaatttagtaatactttattctgccttatttcaaaatgcttcaaaaatgcgaatctggaacttctctgcattgaccactgttctggagttgggctgatagaaaactgcggtgaagagagtttagatcagaggctatggcagagcaaagtattactgatgtgtctcttaacagtgaagagggtcggggaggaggttgggtccttgtcaagtgtcagctgccctatacatagttctcttgccccttgtgccctgttttactatttctaaggtggttcccatgatggcatttcttgataagcccactttgagccgtttaatgttttgtaggtgtttctgtgagtctgataataccagcactaaaaacagttcagtatatagacatttacaagaggtcttaggcctcttcagaattcagttaatgtctttctctttgaggctgctgaatgttaggtaagaattcagggcaagcattcccgaccatcatcaaattggagacttggagtttctattggctggaagaaagttgacccacaggcaaaaccagatgtaaaccaagtttgtcttgggtacttttcaaattcttttcacagcatccttttctcatccctcatggtggcctctggccctggaaaatcctcatgatagcaacttatcaggcctgtttcctctgatagatctggacttttccccttaagtgctttcctgttgggcttctcagactatggagaactgctcatagttgagatctaagagacaaattaccctatggtgttcaagaatggccgtatttagtatactgcctgtcctggaagtgttcacatttaaaaaggcatgactttccaatgggcaaatatcagacacctacatgcatagataagggaaatatgttttacttaagcaaacttctaggcattgaatctcagtgtttaggtgcagagatggaattcctataagcaatgcagtcattcaccacatcaggaaggccaaaaaatgaacactctcgtaattttgttattatctggaaagttctgatatgataatgaacctaaaatactgaatagatagtgaacatcctaaaattccactgaccagaatccattcccatggtcatcatctgtagagggcatgatacaatgacaggcctgaggtatgattataattctggagtaatttaaagcctatatttgttaaactttaacagatggacacacattctctgattttctacttggctctttcctgtactagaaatgcgcatttaactaaaccttcccagcttttctgttcagtgcctgacttacactactcccttaggcaggaggacagtgggtgtctggggaataaaagccaagagctccaaacagaggattttggatacaaagggcagccaccaggaaatagctttgtgagagggacagactatctgattcccatttgtacaaacatgtccaaagcaaaagcacagcattctaaagtggatgcagaaattagtatacaatggcagttctggccagtgcagcccagcatttttctgttgtgcatggaaagaacacagtgaaaaggcaggcagggcatccggtgcaaagtgcaacagacatagacacacaaatccagttttcctgatgagagagggagctatctcttcataagtgatgcaatgcaatgcaggcatgtacaagtacaaggaaagatttatttttaaaaaatcatagtgtaactggatgaataccagcaacagcacctgctaaagcaaacagcctgttcattaaaaactggacttgagggaatggagaaagaatctgaggagcctgcagtcagcatgcttgcagagaccttatggctacagaagacgatgattaacccatagaggttcaatgtagttttcaagaagagggtgggaaagcataagatggggactaagactttgcctttaaccttcatgacatgaagaattgaatgactctttgttggaaaaaatggcagttatgagataattggatccatgttaattatatatatttctgtatatatagtaagtggttattgatgtgcctttgttaaccatttcactatttaataaatgtgtgtgtagtttattc

SEQ ID NO: 18784 - DNA, 946 bp, Homo sapiens
atgcacccctgctaaaggctctcccggcaccggggccacctcgcgcagcgctgcttttgcttctgccgctaacagatggcatgtgccgctgtcgctgccgctgcccctgctgctgccgctgagagcagggccccttagcctctgggtttgcgctagcagcgtaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattg

SEQ ID NO: 18785 - DNA, 891 bp, Homo sapiens
ggggcggcccttggccgcattcccgcccgtcccgcagcggcgcgcggagccagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgcca

SEQ ID NO: 18786 - DNA, 840 bp, Homo sapiens
atcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagataccccaattatcaatagatgaactgaatagcagcatgtttgtttcacagatgtagaagttctcagtagaacactgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttgg

SEQ ID NO: 18787 - DNA, 11294 bp, Homo sapiens
ggggctgagagtgtcttctactttactctgggcaaatgaaggcctgggagagcctgggctgattccatggagagggcttctaagaatcttaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgtttgcctttatatatgtttgaaaatgacaatagaaagggttttatcaccctttgaatgagacagagtggctatactccacagagctcagctgagttcacattactaatatttatgaaagaattttacaaccaaataattcctgtggtgtgtgacatatctcatccactctactcatttattaatgttattatacagtggtggaaacacatgacattttacatcaagtaatagatttaatattttctagtaaataggcgctcttccaccagaaagtataaaaccatcatatacatatatatatatatatataatggtttttctccttcatgaaaatgacaagtaaaaagcaaatctgattgaggataccttaagctggctagaagtgtttgaatcacagaacaatggaattagcaaaatcctttttatagttgatggaactgaatccaggggcatatgacttgcccaaggctaccttagccattgtgggacccagaaatatctcctgcttcccattgttcctccttttcacattgtttttgcttcagaacatttgatgctctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttcttggttatgtctttttttatgaatccatattcacacattaggagttcacttgaaggctattcatgctctagtatattaatcctaatatttagtaattctaaaatgaaatttaaatttctgatttggctcaatgttatatttcatacatagagtaaatttatttccaaatataccatcagtattttgaattatgtagataatatatccgttgtgttagacctattactcttataagattgaagttactgacacaagaaaaacacttctattttaataaaagaatacttaaaattttgagagaatgcttactagtttctcttgtgcctcagaaatcctgaggcatattctaagatgcattattagaagtttctctttcccagttattcatgtctatcctgcatccctagtgtaacatatgaaaccagtgttgtttatttcatactttccagatgggcatcaatcatttcataacaatgagatgcatgaatttttccattaaaatgttttctctcacttaaaattggttatcttcaacaaatggcacagtaataaaaggatgatcatttttgttctttaagaaagtaaatgtaatttagtaatactttattctgccttatttcaaaatgcttcaaaaatgcgaatctggaacttctctgcattgaccactgttctggagttgggctgatagaaaactgcggtgaagagagtttagatcagaggctatggcagagcaaagtattactgatgtgtctcttaacagtgaagagggtcggggaggaggttgggtccttgtcaagtgtcagctgccctatacatagttctcttgccccttgtgccctgttttactatttctaaggtggttcccatgatggcatttcttgataagcccactttgagccgtttaatgttttgtaggtgtttctgtgagtctgataataccagcactaaaaacagttcagtatatagacatttacaagaggtcttaggcctcttcagaattcagttaatgtctttctctttgaggctgctgaatgttaggtaagaattcagggcaagcattcccgaccatcatcaaattggagacttggagtttctattggctggaagaaagttgacccacaggcaaaaccagatgtaaaccaagtttgtcttgggtacttttcaaattcttttcacagcatccttttctcatccctcatggtggcctctggccctggaaaatcctcatgatagcaacttatcaggcctgtttcctctgatagatctggacttttccccttaagtgctttcctgttgggcttctcagactatggagaactgctcatagttgagatctaagagacaaattaccctatggtgttcaagaatggccgtatttagtatactgcctgtcctggaagtgttcacatttaaaaaggcatgactttccaatgggcaaatatcagacacctacatgcatagataagggaaatatgttttacttaagcaaacttctaggcattgaatctcagtgtttaggtgcagagatggaattcctataagcaatgcagtcattcaccacatcaggaaggccaaaaaatgaacactctcgtaattttgttattatctggaaagttctgatatgataatgaacctaaaatactgaatagatagtgaacatcctaaaattccactgaccagaatccattcccatggtcatcatctgtagagggcatgatacaatgacaggcctgaggtatgattataattctggagtaatttaaagcctatatttgttaaactttaacagatggacacacattctctgattttctacttggctctttcctgtactagaaatgcgcatttaactaaaccttcccagcttttctgttcagtgcctgacttacactactcccttaggcaggaggacagtgggtgtctggggaataaaagccaagagctccaaacagaggattttggatacaaagggcagccaccaggaaatagctttgtgagagggacagactatctgattcccatttgtacaaacatgtccaaagcaaaagcacagcattctaaagtggatgcagaaattagtatacaatggcagttctggccagtgcagcccagcatttttctgttgtgcatggaaagaacacagtgaaaaggcaggcagggcatccggtgcaaagtgcaacagacatagacacacaaatccagttttcctgatgagagagggagctatctcttcataagtgatgcaatgcaatgcaggcatgtacaagtacaaggaaagatttatttttaaaaaatcatagtgtaactggatgaataccagcaacagcacctgctaaagcaaacagcctgttcattaaaaactggacttgagggaatggagaaagaatctgaggagcctgcagtcagcatgcttgcagagaccttatggctacagaagacgatgattaacccatagaggttcaatgtagttttcaagaagagggtgggaaagcataagatggggactaagactttgcctttaaccttcatgacatgaagaattgaatgactctttgttggaaaaaatggcagttatgagataattggatccatgttaattatatatatttctgtatatatagtaagtggttattgatgtgcctttgttaaccatttcactatttaataaatgtgtgtgtagtttattc

SEQ ID NO: 18788 - DNA, 1815 bp, Homo sapiens
acaacttggaatgtcctgcaatatctaacatgtaagcacgtcgaatcattttctagacagaatctgaacctctgtgtctctcagtctttctctctttctcattctctttcaatatggaacttgaaaagcgtgaaaaaagaagcttattaaacaagaatttagaggagaaactgacggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaa

SEQ ID NO: 18789 - DNA, 1044 bp, Homo sapiens
ttggtttgctcgctcccttatgtgatgaatcaatgctttcagaacaggggcttctgagtgactgcgggaacaattacttccaaatgacctcgtgcatcttatcagggagcattcagaccacaccccaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacagctgagtcatccaatggtggctattcctgaacatgaagctcttgattccaaagagcaatgaagttggagcagaggctgaaaacacaggctgctgaagttttttggaatgctggtgctaaccacttgctagatttaactttttttttttt

SEQ ID NO: 18790 - DNA, 1076 bp, Homo sapiens
actgctttcttgacatctgctagtttgacacgtggcaccggattccatgtgcagctggtaccttggatttgaatgttcttctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaa

SEQ ID NO: 18791 - DNA, 1386 bp, Homo sapiens
ttggtttgctcgctcccttatgtgatgaatcaatgctttcagaacaggggcttctgagtgactgcgggaacaattacttccaaatgacctcgtgcatcttatcagggagcattcagaccacaccccaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaactttttttttttt

SEQ ID NO: 18792 - DNA, 11156 bp, Homo sapiens
gctgccagcggtcggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttaaatatatatatatatatattttttcttactttatcttttaagaattaatgagtataaaagaaaaattaggcagtttacccttttcagatttttatttcttttttttttaattgggggaaataagcactattaacagattcagcactacaagtattttgaatgttgttgctgttggtcatttggcctgccttttcccttcctatttcactttgcctcccatcacacaactgcgtgtaaatggtgtcacttgttcacctctttacttcattcttaacaagtgtatagttctctaggacagttgatgtatgttaaggtgatatctgtgtctgtattgacttgtcttgtgttacattaaacagtaggcagaactgaggtctcaagtttgcactcttggccatagaactaaaaatgaaacctgagattgacccaagcacctatctgagattggtatataatatttctataatgatatattttatagtagatattacaatagcatctgactttgagtcacagaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattcactgggtaattgtgggtcatttatttcctgaaagtcacgtgaaatccttagctggttgaatgttgcacagtatttgagaattacggtttgaagtgatttctgtgggagggaatcattgcaatgtatattctaaataaagtcatctaactattaaaaaaaaaacacccttcctaacccttcttttcttaaaattccacattcatccacaatctcatccctttgtagaaattcttgcctgaattctcaccaagttttgaattcctaaggtagccccgatctaggatgtgaaggctgcccagaaaaagtttatggctggaggagtatcatacagtgtctacatatgatagtacttacagattaggtctttggatgctttaacacaaaagatttttgttatccttattagtcaaataacgctattcttttgtggttctagaccctggcttctatctccctgtgatttgttttaatgctgaaatgacttggctatccaaagcttctagtctagaggtctgttggttgaaggcagacatttccaagtttgttgaaataatacgaagctgactagcttacgtgaatgatgttgccctcatttgttttgggtgaggactcattactgcagtatattgatctcttcaccaaatgctttttctttttctgaataaatgctgtattagaggttctatttatatatgatttttaaaactttggtttccttctatccaccaaatactgtgaattgtttttccatttatttttcttagctaatgtaactttattcttcacttttttttagccctagacttcctagattttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttattgtattttttaacctttttgtttctattcctacctcccatgagtaacattgatttctgctgaagttagaatttgtgttaagaattgactttaaacttctgaaatagttgaatattagaagtggcttcagttgccatgaaatgattgcttttctttttctttttttttccttaaataaaaataatgcagccttatatatgtctcttcccctcaagaatgtgaatttaggctgggcatagtgactcacgcctgtaatcccagacctttgggaggctgacacgggaagattgcttgagcccaggaatttcagaccagcctgggcaacacaggaagactccatctctacttaaaatatttttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaagaatgtgaatttagctccaattccaaatgactaactcttaggccagtcatagccaatgaaatcatctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagcttaaaaacacaaaaatgaaagggtagtcctagtttatcttcttaattagaatcattatttggaaataagatttgcaatgtgctgtctatccccaaacactgctgagcttgctggaaaacagaatttaacatgaatgttgtctgaaagctgtaggatcaatggcaaaaaaggggaaatgtttggtagggaattggaccagttctaaggtatcacttttaattataaaataatgtcttcctttttatctgcttttcagacagcctcagtgaactattaaacatttgtgtgcaaagtcctattttgcttatctaaggcattttgacttggaagtattaaacttcaggaacgagctagagaagacaatgagggtatgttagagaaggaaaaataggagctttttgcttatggattttagaggtccacaaatcgaaaggaaaaataaatttcttcatttctaaccctaaaataattttgttaatgagatgctgggaagaagactaccaaaaggcctcaaagctcatgcttctagaatattcagtaattctgaatagtctttgggaagtagcatttcttgggaagtagcatttcccttcttccaaataactgtttgagatcttaaaacagaaaatccagtgttaatgggctctagatcttaaactaggtgagcagcttcttacatacaaccagttccttgttaaggatccagcaggaaaaccagccataaaacatttcaacatgcagtttgggggctcccttgcttattcactgagtttaagctcttgctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaagaagaaacactgtgtgatatactgaacaagcctgtgtgcatgaataaggagccactcaaaaagccaattttgagctttatttctccgttgttaacaaatctcaagaaagcctttgttacagtttagctcatgtcatttggttggttttattttctagccctttaacataggaggaaaattgtcatttcatgtataacttgtaacacagaattgaactgatactagtttccttgccttaaattaattatatgtcatcccaagggtctctgttaattctgctttgccaagcaataatgagatctgggtttggcattagaagtatttcataattttggttttttatttaggtttcctccacatctgtaaagtgattgattaaattagaggaggcgtgtagaataaatcccaatcccattgcaactggcagagctttataaatctttataaattcagttacaacaaaggagaggatcctacaccattagagccatgccatcaggtgtttgcaagtgacagctgtagtgtgttgcctcaaataataccaagttataaataataccaagtaattatcaactcactcccaaatttaataagatatcaaagtccaaaaggttacttaggagtagtcttccgtgggggaagataaatttattaaagagtcatgtactgatctttttcttgggattttttttcctttcccagaaaaaaaaattattttggtgactgatcaattgtaaacaattttcttccttacttacaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagcgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaaccgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgctacaag

SEQ ID NO: 18793 - DNA, 2408 bp, Homo sapiens
ggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagaggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagtt

SEQ ID NO: 18794 - DNA, 3476 bp, Homo sapiens
atgactccgggcggtcggagaaggtctgccgggagtacacctgccctctgcctgaagcgtccccaagtgtcccgggcccgcgtcgttgccggatgcacaatgctgacacccttcccgggggcttccagtgtattctgcctcctcttgtgttcccgttgccacccttagctccctgactcttccagccaccttcccctcctccctcttccctgaggtgcctcctcgggcgattccagagcgcccatcttcccagtccgggcaaaacccggagaggtggaatccctcgcccggagcgccccggcggccactgggcatgctccgttgtcaggcaagttcggggctgcaggcagcttgcgcgccgcgcggattccagctgcggtcgcgcgtactcctcctcccaagtagggagcgggcgcatgatggcggccgcggcggcagcggctgcggggagctccagcagcggcggcggcggcggcggcagcggcagcagcagcagcagcagcgacacgtccagcaccggcgaggaggagaggatgcggcgcctcttccagacgtgcgacggcgacggggacggatacatcagcagaaatgacttgctaatggtctgtcgccagctgaatatggaagagtctgtggctgagatcatgaaccagttgggagcagatgaaaatgggaagatttcctttcaggatttcacaagatgccgcatgcagcttgttcgagaaattaggaaggaggaagtagatctttctgcaaagtcagacaactcctgtacaaagaagctgagggatagaattgcttcctggcccacgagcagtgacaacagtttgggtgccttatcagcagccagggagagctgggaatacgactctggtgccagggacctccagagcccggatgtgcagagccagtcagccctccagaagctgctcgagtatggcggaagctctttgcatcagcaggctgctctccacaaactgctcacacagtccccgcacattggcaactctgtaggaggaagctatctagagctggccaacacactccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaa

SEQ ID NO: 18795 - DNA, 2684 bp, Homo sapiens
aggcgcagcgtggccgcgggtgggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctataatcttgcccatagtatttacctcatttttgtgtctgttttgctgtgggtaagctttataagataaataatgtctatacatgtttcgactgtttaatgagtaatcaacaaaatctgccagagagtccctctggaaccatataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggtgaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttacccta

SEQ ID NO: 18796 - DNA, 1273 bp, Homo sapiens
ggtgggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaaaatgaagactaaaccatagttaaaggcagacagtgtaatatccagtggctgtgtgttctgacggtgaagatgtagtgtaactatcagaaaatagaaggagatggaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagc

SEQ ID NO: 18797 - DNA, 4558 bp, Homo sapiens
gacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctattttttttttttttttttaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaa

SEQ ID NO: 18798 - DNA, 4104 bp, Homo sapiens
ctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacagactctgagattcacaatcagcagctctaaaaaataaaggagcagtttggcttccggaaggaagaggaggcaacactcgg

SEQ ID NO: 18799 - DNA, 1874 bp, Homo sapiens
ctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagccccaggagaggtccgaaggcccagcccagccacctcatgcgccaggtggcccggagcgccccaagttggagaagaaggatgccaaggagatccccagtgcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaagcacaggtgaggaaggcagggaagccctga

SEQ ID NO: 18800 - DNA, 7785 bp, Homo sapiens
gcgggatctctcgggaggacggacggggtcaggtcccatcatggcggctgaagaggcggatgtggatatcgaaggggacgtggtagcggcggcgggggcacagccaggaagtggtgaaaatacagcatcagttttacaaaaagatcactatcttgattcatcttggagaacagagaatggccttattccttggaccttggataacaccatcagtgaagagaacagagctgttattgagaaaatgttgttggaagaagaatattatttatctaaaaaatcacaaccggaaaaagtctggcttgatcaaaaggaagatgataaaaaatacatgaagagtctgcagaaaacagcaaaaatcatggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccaaaatacttaaataagacctcagtacgtcctggcctgaagaactgtggagatgttaattgtattggacggattcatacatacctcgaattgataggagcaatcaattttggatgtgaacaggctgtgtataataggccacaaacagttgacaaagtacgaatcagagacagaaaagatgcagtagaagcataccaacttgcccagcgtctgcagtctatgcgtacaaggagacgtagggtccgagacccatggggaaactggtgtgatgcaaaggacttagaaggacaaacgtttgagcatctctctgctgaggagttggcaaaaagaagagaagaggaaaaaggcagacctgttaaatctttaaaagtgccaagaccaacaaaaagctcgtttgatcccttccaactgataccttgtaatttttttagtgaagaaaagcaggagccatttcaggtgaaagtggcttcagaagcacttttaataatggatttgcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaaggaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatgttccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatgttacatattcagcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccagtattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggcctgtaaaatagagatggacagaccatgcatgtttccatgaagctatttaatgctgctcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatgtaatttcaactattttgtacatttaaatatgccatgttgtatatgtctgtatttaaaaatgttgtaaatacctgcattttaagaattatgaaagattttcctcaaaaatgacagaactctccatacttaattgtgacacattataagatatctgattttaagcttttggattttgttctaaaaattaagtttaaacatgctgaaaattccataaaaataaaattttgaaaataaagtga

SEQ ID NO: 18801 - DNA, 1349 bp, Homo sapiens
gtgagtggggcgctctcgtgggcatcccagcgccggggcaggccgggtagtgcccgatcccgcggggcgcgcgctgctgctttaggcacccgggctcgggtgcgggtctgggagacctgtcggtcggcgagaagcctcggtggccggcgctgtggttgcgggacctgggacgcgctcccaggcgtcccacctccccggagactggggcagggtgggtggggcccggatctaggggtagggtcgcggaagccttggttacagagagtcgcacacgtggcctgctaatggtcgcgacaccggtgacgagcgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaatgatgctggagctagaatgagaagatgtgacttgagggccattgctccccagaaatga

SEQ ID NO: 18802 - DNA, 2923 bp, Homo sapiens
gtgcccacgctgccccgcctccagccgctgcgccgcaacgcagtgggctcgcggccgcgagcaacaggccgtgccgggtgagtggggcgctctcgtgggcatcccagcgccggggcaggccgggtagtgcccgatcccgcggggcgcgcgctgctgctttaggcacccgggctcgggtgcgggtctgggagacctgtcggtcggcgagaagcctcggtggccggcgctgtggttgcgggacctgggacgcgctcccaggcgtcccacctccccggagactggggcagggtgggtggggcccggatctaggggtagggtcgcggaagccttggttacagagagtcgcacacgtggcctgctaatggtcgcgacaccggtgacgagcgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaa

SEQ ID NO: 18803 - DNA, 2232 bp, Homo sapiens
acaccggtgacgagcgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaattcatggggagatttccttttggataccatctcggggcttgtatttgatactgcaaaggaagacgtggagttacggaccggcataccccggcagctgctcctggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaa

SEQ ID NO: 18804 - DNA, 2341 bp, Homo sapiens
acgctgccccgcctccagccgctgcgccgcaacgcagtgggctcgcggccgcgagcaacaggccgtgccgggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttg

SEQ ID NO: 18805 - DNA, 4003 bp, Homo sapiens
atgctccttcaggtaccatgtaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggcaaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagaggctggagaaaatgttcattctgctcagtgatccaggagtgtgaggacagtagcttcctttccacgtccacaagacaatgacagatgtgtttccttctttgctctttctagggatctttctagggatgttgattctctcacaatatttcaatgtcccatttctgtgtttcttctccctccaggggctgatttacaattacatgagtcttgtcacaataatttcctcctaaaatagaaattccaaaagaaaagattatttgttcaggcaggtgcttagcaatttcacaattttcacaagcttctgttcagctcaccatttcggtggatgaatgtgtcatttacaaagaagtctgaaatgggaagctgagtttgaacaggcttagccattattcacctcaaattggaccttattatgactcaaattgaaatactaaaaggtataatacatgattgtataagtggcgtgccttaatgtgattctttagaacaaagtgctcttgagagaactctggctgaatgtcaggtactgtgtttttgtttctacaccaacaaaactgtgactaacccaattaaagcaacagccatgaataatattggccctgaccttgctgaattcaaaaacaaggttaattgatacctaccataaattctacctgagggtttttaaggaccatggcaattcctggcaaaaagctagagatgtttctaagaaacagatgacattcatttcatggtttatggtgcttgaaatttagaactgttctgagttcacgtagcaaatgaaagttttacaactgtactaatgaacaaaaaccctaagctttgttgtttggctttttctgctaattgttttgtttgtaaaactgcctatcttaattttcttcaagcataattttaaatgacttaacatttctcttatacataaggatgtcctttacccaaaatgaggagatttggaactgaaactaatatccagggacacaacattgggtatcatcaaaggcccacctttaacatcaaggacaagttgatcactgagataagagctgatagttccatttttattcagtctccacttctgcctgaattgcccatgttcagtccatagagctactttagctccaggtgtgtcccggccaccaatcacatcaagacatgtatcactggcctaaaagggttaagaaatgattaattggcagtagtatgtttgctaaagtaagttgaattaggtcccttttatcttaggtaaacaagtcatagacatgaagtgtgtgtgtgtcttatctaaaaaaatactatatagtataatttcagtaagccttttttaatgtcttctttacggctgtgggtaggagatggtacagaaataaaccaactgaaatagaggtacttgtttttaataggatgtctacatctgacaacagatgttcaataaagatttggtgaattggaattaaatgttaaatccctgtttgcttaaaacgtattatgttgagcttggttttcttatgaaaacattgcatgatgggctaaagatatccagacaataattacttttaaaagtttttcatttttgaagcatgagaaaaagtagataatccattggtgatacaataaaacacagtttgaatgttt

SEQ ID NO: 18806 - DNA, 664 bp, Homo sapiens
gcttccaattcatttaccagcaaataattccgcaacgattggccgacagctgggttgtccaacaggttactgagaccaggttattcactgttttcaggaaggatagactgggaggaagaggatctgatttcgccactcattagctgtaaatctggtgcctcgggtttcatgtcactgggctcatctttgagcagaggaacctgatttactcagcttcttctgctggtactggtttttgcctcctggacatcaagctttgtaacctcatggtcacgaaaatacattgaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttt

SEQ ID NO: 18807 - DNA, 2777 bp, Homo sapiens
ttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattg

SEQ ID NO: 18808 - DNA, 2552 bp, Homo sapiens
ttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattg

SEQ ID NO: 18809 - DNA, 991 bp, Homo sapiens
aaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatcggcgctgtgcaaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttagggg

SEQ ID NO: 18810 - DNA, 2333 bp, Homo sapiens
ccagggtgagcgcgagccacctccctccctccctccgccatggatcccagcaactggagcagcttcatcttccagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaat

SEQ ID NO: 18811 - DNA, 3186 bp, Homo sapiens
tggtgacgtcacggcgctcgtcggcgccgcctgtggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcacatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacagcatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagcctgcacagtgaggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttct

SEQ ID NO: 18812 - DNA, 3111 bp, Homo sapiens
ggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcacatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacagcatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagcctgcacagtgaggtgcatcctggcagatgcgttccttgggagaacaccatgcagggtgcattcccatcaactaccaggtgcggtggctcgtgcctgtaatcccagcactttgggaggccaaggtgggcagattgcctgagctcaggagttcaagaccagcctgggcaacatggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctact

SEQ ID NO: 18813 - DNA, 2390 bp, Homo sapiens
aagtgggggcctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 18814 - DNA, 2426 bp, Homo sapiens
cctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagtccaaagaggtttctaccctggaatctcactgagtgccccaggagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 18815 - DNA, 2380 bp, Homo sapiens
ctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 18816 - DNA, 2323 bp, Homo sapiens
agaggtgcagaagcaactgagtccaagttgtctggcggcttcaggtggacccagaagacgtccccaactcagggagattcaggtaacggctgacaggtgctggggacctaaaggctttggcccctgagcaggttggagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 18817 - DNA, 2772 bp, Homo sapiens
tgggtgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggt

SEQ ID NO: 18818 - DNA, 1255 bp, Homo sapiens
agacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctg

SEQ ID NO: 18819 - DNA, 2281 bp, Homo sapiens
aacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtatttgca

SEQ ID NO: 18820 - DNA, 4844 bp, Homo sapiens
cgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 18821 - DNA, 4800 bp, Homo sapiens
tcctttcgcgtccacctgagcccccccgttttggaaggtggagtggggcttgggaaaaggttcaagcgtctttggggacccccgtgcgactctggctggaaacaggcgagctctggttccttgttccgttttccaattgcaacaaccctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 18822 - DNA, 2127 bp, Homo sapiens
aaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatatt

SEQ ID NO: 18823 - DNA, 2145 bp, Homo sapiens
gagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaa

SEQ ID NO: 18824 - DNA, 875 bp, Homo sapiens
caattctaaatgccccacttctttcatgcatgaattgcaaaaagatgtggcaagttttgtttctaccaagaaaactaaaaacaccttttgtcaaataaatgctccttgcatatttaacttatgcaccagtggccttttaaacagtcaatgtcccatcaaggtgcctgcacatctgggctctccgggagcagccatggcagcacccgggaagaaacgctgatgtggctgctctgcatgctcagatgacttcatcgggaagcctgggtgcattttacgctgggtgccaaatctcgagtaactgaggaattcccagagccttctgaaacacagagctgcaataaggctgctccatccaggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccg

SEQ ID NO: 18825 - DNA, 2503 bp, Homo sapiens
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18826 - DNA, 1568 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18827 - DNA, 1529 bp, Homo sapiens
cttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaa

SEQ ID NO: 18828 - DNA, 889 bp, Homo sapiens
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 18829 - DNA, 1027 bp, Homo sapiens
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 18830 - DNA, 2296 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttct

SEQ ID NO: 18831 - DNA, 2160 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 18832 - DNA, 1591 bp, Homo sapiens
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18833 - DNA, 2087 bp, Homo sapiens
caattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18834 - DNA, 2146 bp, Homo sapiens
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18835 - DNA, 1616 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18836 - DNA, 910 bp, Homo sapiens
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 18837 - DNA, 675 bp, Homo sapiens
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctga

SEQ ID NO: 18838 - DNA, 1858 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18839 - DNA, 1620 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18840 - DNA, 1572 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18841 - DNA, 1730 bp, Homo sapiens
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18842 - DNA, 1587 bp, Homo sapiens
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18843 - DNA, 1541 bp, Homo sapiens
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18844 - DNA, 1579 bp, Homo sapiens
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18845 - DNA, 1870 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18846 - DNA, 1866 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18847 - DNA, 1866 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18848 - DNA, 1685 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 18849 - DNA, 2146 bp, Homo sapiens
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18850 - DNA, 1730 bp, Homo sapiens; identical to SEQ ID NO: 18841

SEQ ID NO: 18851 - DNA, 1726 bp, Homo sapiens
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18852 - DNA, 1685 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18853 - DNA, 1612 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18854 - DNA, 2499 bp, Homo sapiens
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18855 - DNA, 1568 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18856 - DNA, 1681 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18857 - DNA, 1734 bp, Homo sapiens
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18858 - DNA, 2499 bp, Homo sapiens
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18859 - DNA, 2503 bp, Homo sapiens; identical to SEQ ID NO: 18825

SEQ ID NO: 18860 - DNA, 1583 bp, Homo sapiens
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18861 - DNA, 1685 bp, Homo sapiens; identical to SEQ ID NO: 18848

SEQ ID NO: 18862 - DNA, 2142 bp, Homo sapiens
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18863 - DNA, 1541 bp, Homo sapiens
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18864 - DNA, 2495 bp, Homo sapiens
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18865 - DNA, 1616 bp, Homo sapiens; identical to SEQ ID NO: 18835

SEQ ID NO: 18866 - DNA, 1587 bp, Homo sapiens
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18867 - DNA, 1722 bp, Homo sapiens
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18868 - DNA, 1814 bp, Homo sapiens
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 18869 - DNA, 2146 bp, Homo sapiens; identical to SEQ ID NO: 18834

SEQ ID NO: 18870 - DNA, 1583 bp, Homo sapiens
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18871 - DNA, 1568 bp, Homo sapiens; identical to SEQ ID NO: 18826

SEQ ID NO: 18872 - DNA, 1533 bp, Homo sapiens
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18873 - DNA, 1862 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18874 - DNA, 1616 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18875 - DNA, 2507 bp, Homo sapiens
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18876 - DNA, 1726 bp, Homo sapiens
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18877 - DNA, 1564 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18878 - DNA, 1681 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18879 - DNA, 1564 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18880 - DNA, 1866 bp, Homo sapiens; identical to SEQ ID NO: 18846

SEQ ID NO: 18881 - DNA, 1541 bp, Homo sapiens; identical to SEQ ID NO: 18843

SEQ ID NO: 18882 - DNA, 1862 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18883 - DNA, 1689 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18884 - DNA, 2142 bp, Homo sapiens
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18885 - DNA, 1545 bp, Homo sapiens
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 18886 - DNA, 2503 bp, Homo sapiens
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18887 - DNA, 1677 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18888 - DNA, 1730 bp, Homo sapiens
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 18889 - DNA, 1587 bp, Homo sapiens; identical to SEQ ID NO: 18842

SEQ ID NO: 18890 - DNA, 2138 bp, Homo sapiens
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18891 - DNA, 1560 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18892 - DNA, 1537 bp, Homo sapiens
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 18893 - DNA, 1612 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18894 - DNA, 1537 bp, Homo sapiens
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 18895 - DNA, 1608 bp, Homo sapiens
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 18896 - DNA, 958 bp, Homo sapiens
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 18897 - DNA, 2046 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttct

SEQ ID NO: 18898 - DNA, 1436 bp, Homo sapiens
aagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgc

SEQ ID NO: 18899 - DNA, 322 bp, Homo sapiens
caattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcaggattggttgcagtggcacgatcatggctcattgcagcctccacctcccaggctcaagtgatcctcctgactcagcctcttgaatag

SEQ ID NO: 18900 - DNA, 2045 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttct

SEQ ID NO: 18901 - DNA, 2296 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttct

SEQ ID NO: 18902 - DNA, 2296 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttct

SEQ ID NO: 18903 - DNA, 1774 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttct

SEQ ID NO: 18904 - DNA, 2045 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttct

SEQ ID NO: 18905 - DNA, 1774 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttct

SEQ ID NO: 18906 - DNA, 1436 bp, Homo sapiens; identical to SEQ ID NO: 18898

SEQ ID NO: 18907 - DNA, 1770 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttct

SEQ ID NO: 18908 - DNA, 1774 bp, Homo sapiens; identical to SEQ ID NO: 18905

SEQ ID NO: 18909 - DNA, 1436 bp, Homo sapiens; identical to SEQ ID NO: 18898

SEQ ID NO: 18910 - DNA, 1770 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttct

SEQ ID NO: 18911 - DNA, 322 bp, Homo sapiens; identical to SEQ ID NO: 18899

SEQ ID NO: 18912 - DNA, 1778 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttct

SEQ ID NO: 18913 - DNA, 2300 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttct

SEQ ID NO: 18914 - DNA, 769 bp, Homo sapiens
caattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgtcttccacctggaagccctctctggctaa

SEQ ID NO: 18915 - DNA, 2300 bp, Homo sapiens; identical to SEQ ID NO: 18913

SEQ ID NO: 18916 - DNA, 664 bp, Homo sapiens
caattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtga

SEQ ID NO: 18917 - DNA, 2049 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttct

SEQ ID NO: 18918 - DNA, 322 bp, Homo sapiens; identical to SEQ ID NO: 18899

SEQ ID NO: 18919 - DNA, 2045 bp, Homo sapiens; identical to SEQ ID NO: 18900

SEQ ID NO: 18920 - DNA, 322 bp, Homo sapiens; identical to SEQ ID NO: 18899

SEQ ID NO: 18921 - DNA, 1436 bp, Homo sapiens; identical to SEQ ID NO: 18898

SEQ ID NO: 18922 - DNA, 2300 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttct

SEQ ID NO: 18923 - DNA, 1436 bp, Homo sapiens
aagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgc

SEQ ID NO: 18924 - DNA, 2041 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttct

SEQ ID NO: 18925 - DNA, 322 bp, Homo sapiens; identical to SEQ ID NO: 18899

SEQ ID NO: 18926 - DNA, 322 bp, Homo sapiens; identical to SEQ ID NO: 18899

SEQ ID NO: 18927 - DNA, 1436 bp, Homo sapiens; identical to SEQ ID NO: 18898

SEQ ID NO: 18928 - DNA, 2304 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttct

SEQ ID NO: 18929 - DNA, 1436 bp, Homo sapiens; identical to SEQ ID NO: 18898

SEQ ID NO: 18930 - DNA, 322 bp, Homo sapiens; identical to SEQ ID NO: 18899

SEQ ID NO: 18931 - DNA, 2041 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttct

SEQ ID NO: 18932 - DNA, 327 bp, Homo sapiens
atggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctga

SEQ ID NO: 18933 - DNA, 820 bp, Homo sapiens
gttcagttcctggtcccccactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatcaatgctggaccacagcagaagcaccaaagctgtcagtgagaagaaggccaaggggctgggggagtctcgcaaggataagaaatagcggttag

SEQ ID NO: 18934 - DNA, 1951 bp, Homo sapiens
gttcagttcctggtcccccactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttcc

SEQ ID NO: 18935 - DNA, 1693 bp, Homo sapiens
cactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 18936 - DNA, 1955 bp, Homo sapiens
gttcagttcctggtcccccactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 18937 - DNA, 2620 bp, Homo sapiens
gaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaagggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaaaattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatac

SEQ ID NO: 18938 - DNA, 1370 bp, Homo sapiens
aacagtctgggacatttcagactggcaccacctcctctggctgtttccgaggccatctagaggccagagcccagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaatcaaaa

SEQ ID NO: 18939 - DNA, 3964 bp, Homo sapiens
tgtgtcgttaccgggagctgtaaacaaggtgtgcaagcatctgaagagctgccgggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaaacttactatagactggacatatcgccctcccagcagcagccacacagtatcaatatttcattatcagtctttccagtacccaaccacagcaggcacatttcgggatcggatttcctgggttggaaatgtatacaaaggggatgcatctataagtataagcaaccctaccataaaggacaatgggacattcagctgtgctgtgaagaatcccccagatgtgcatcataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaactctcataagagactcatgacttcccctttcaatgaattatgctgtaattgaatgaagaaattcttttcctgagcaaaaagatactttttgattcatctttgctctggaatgtattacatgttttcttccaactgtttgaaggagaattttgaatgtttgccacaccgctgatacccaaataattttttaaatgaagtggagcttgtggcttcctgatgtgtcaccagacaaaatattcgcttgggatatgtattctttgttttttgctccatgtacactttcagctgtgagttagtatagggcgtatacttaccggtttaatgacctcaacctcagttgtgtttggataacttagggtgtatacccttagtttccttagagttggtaggatcaagtcattggtttgctttgactgggtttttaaagtattaagtacagtgtcatcaatttacagttaaggaaaggaatcgtgaagtagaaaaattattttctttagtcttgctggtacaatttgggctaaggagtctttgttattttctgtcttgcttttttttttttttttttttttttgaggcagagtctcactctgtcgccaggctggagtgcagtggtgtgatcttggctcactgcaacctctgcctcctgggttcaagcgattcttgtgcctcagcctctcgagtagctgggattacaggcatgcgccaccacacccagctaatttttgtgtttttagtagagacggggtttcaccattttggccaggatggtctcaatcccctgacctcgtgatccacctgcctcggcctcccaaagtgttgggattacaggcatgagccactgtgcttggcctgttattttattttcttataactacaacttttcttcttgaattttcaggtcagaggcaagaaaaactctttacaggtttttagtggggggcttatggagtatttcaggagttctttgcaaattaaatcatcttttcacttgtattgtttttcaaaactttgttgatttctaaaatgtgccaactgtgagtaaactatggtatttgcaagtggtttttacataatatttgagatgaggaagtgagattgtgcatgacatacttctcctttgtattctctcagtgccttacagcaggttactccattctgctatgacaacttgtttcaaatgttaatttacataggattttttataagccattaaggcatatgtatagtatatcagtaaagatggatggtgcatatataaatagtcttctgtaatagtgattggatttacttctcaattatgagagacaaaaattatcccctcacctgtctctattctttcaacaggttgatcccttttcatgatttttcattaggtggttcaggaagtttccatattacagcgcttcagactgtatatgttagtttaaaaatcacttttctctctctcaacttctttcttttttttttgaagacttaatttaaaaaatttgggttgttagatccgtatcatagatttggcctagcctcttctgttaacctagtccacagatgagcgaatctggttagttgaaggacattgtgatttgactctggtcacgcgaggaagtagaagggcaaagacaggaccggcagtttacatttccagtggttaaacctcacggtactttgggactgcttgttaacttttgtggttgtctgaggccaatctaacgtgaccatttctgacacctcaacagagagaggaaagcaacttgagcaatgagagtaaataacttgggctctcagagatttgaagatagagatctcattgtgagggggactattttgcaggtcctcatttctccaagaaagagatggtgttacaggaacccactgaaagccatatcccattaaatgaggaactaattttggctgggccttcttgtaatgtcctcgcaggtgtgttgtgaagattaatgcagggtagtatgtttgtagattgacacctagtctaaacttgaggtaattggtgctctgtgaatactcagtcgtgttcttttatagccttaatcatgatttgaactagtcccttgctttttaaatgactgaatgaagtccttcgtggtaagggagtacgttgataacttagtttactatatgggtttgtggtcgcatcccagtcatcagctgctatcattttccttcttcatcccttatactgagatttgggttacagctttttattcttcgaaggatcacaaagcagtgtacagacacctgccttctttaaggatgaaaggaagataaagtggtctttttttgtttacttatttgtttcacctcttgtttgagtaacttctaaggtgctattctctctctctttttgctacctcatgagctcttgtcacagccatggaaaccagcctcgtttagaaagggaacttagttcagaaggggttaaaagccttccagaatttttctttagctgctgaagtttttacatgtggttacatgactttaagttttatgcattacgctcttaattctattacaaaatgtggactcaccaattgctttgtgttttccatgtgacctgttacttcaggctacttggggaacatcttagtcctctgtagctcctgaacccagcactggtgcttcaagagagaaggtagcacgtctttgttcaaaacaaaacaaaacgacacttctggaggccacatcctgaatatgaatgttctactaagtcactcagttatggttctaaagggaaactgtaagaagacccacaaggagtggaccaagactattatttaattgcacaacttgaaactttgctgccagaagaggcagctccattcctttgactccagtgttgggctgttaactgctgcacctcattgcctttttttgtttttgtttttgttttgtaggagggtaggcactgttgggccatatgcacaaatattgtaactcttggtatctttactgcatcatagtcaataaacttctttgtaccctttg

SEQ ID NO: 18940 - DNA, 1381 bp, Homo sapiens
gtcgttaccgggagctgtaaacaaggtgtgcaagcatctgaagagctgccgggatgcagcagagaggagcagctggaagccgtggctgcgctctcttccctctgctgggcgtcctgttcttccaggatgcccatgtccgaggttatgttggagaaaagatcaagttgaaatgcactttcaagtcaacttcagatgtcactgacaaacttactatagactggacatatcgccctcccagcagcagccacacagtatcaatatttcattatcagtctttccagtacccaaccacagcaggcacatttcgggatcggatttcctgggttggaaatgtatacaaaggggatgcatctataagtataagcaaccctaccataaaggacaatgggacattcagctgtgctgtgaagaatcccccagatgtgcatcataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaactctcataagagactcatgacttcccctttcaatgaattatgctgtaattgaatgaagaaattcttttcctgagcaaaaagatactttttgattcatctttgctctggaatgtattacatgttttcttccaactgtttgaaggagaattttgaatgtttgccacaccgctgatacccaaataattttttaaatgaagtggagcttgtggcttcctgatgtgtcaccagacaaaatattcgcttgggatatgtattctttgttttttgctccatgtacactttcagctgtgagttagtatagggcgtatacttaccggtttaatgacctcaacctcagttgtgtttggataacttagggtgtatacccttagtttccttagagttggtaggatcaagtcattggtttgctttgactgggtttttaaagtattaagtacagtgtcatcaatttacagttaa

SEQ ID NO: 18941 - DNA, 5533 bp, Homo sapiens
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtg

SEQ ID NO: 18942 - DNA, 2059 bp, Homo sapiens
cggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcaggtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataatgtaaaaaaactcctactagattcccttttcattaatacaacgggtcacctaactgaccaacgcc

SEQ ID NO: 18943 - DNA, 5614 bp, Homo sapiens
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtg

SEQ ID NO: 18944 - DNA, 6953 bp, Homo sapiens
cagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgaggaggaggaggaggaagaggaagaagaaaacgaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatgatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccacatttgtagcacgaagg

SEQ ID NO: 18945 - DNA, 7063 bp, Homo sapiens
ggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgatgagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacgaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccacatttgtagcacgaaggatctctaa

SEQ ID NO: 18946 - DNA, 3642 bp, Homo sapiens
aagcgcctggaagcggaagctggacagacgaggagaggccttgggtgtgacatcaacggaacctgagggaagcaaaactcagcaaggacgcacccggtctgctggactggggctttggcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcaggtaacaattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccaca

SEQ ID NO: 18947 - DNA, 4850 bp, Homo sapiens
tttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgatgagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacgaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatgatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtggggg

SEQ ID NO: 18948 - DNA, 802 bp, Homo sapiens
aagtggatcttcgctgaggactcatcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaa

SEQ ID NO: 18949 - DNA, 3051 bp, Homo sapiens
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagcccatagtcagagccataattggctctggggaagatccaagttattttctgagtaagatattaggcttccatatgatccagagatgcaaagaaatccctagagagtgtaggagttgtctaaatccatgtgtcagatgtagccaacgaattatgtcagaagcagagagaaaaggcctgaaaagcagctctctcccactcctcaggcccttgtctccaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcctcatggcacttcaccaccagaagtggtgctcagagttcctatttccacatctaaccccctaattcctgggaaagtctgaggcctggtccccccagtgctttccctggctggcctctccacattttcatctgatggtggagtgagatcaggaaaaataggacaggagctttgccttgggggagaagagagttaagtgtggaaaggggtgagttataggaggttaagcagtccaagatttctctctctgtgtaggaggccatttcctgatgtgaggggtctgaacccaattatgatgggacagggttgggcattgacttcccatctcttctctctgtttttctcccactatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgtgtgtgtgtgtgtatgttgggaaacttagctttcagagaatgtctatgggctctcattttctctctcacacaaaaatactcgggacttctccaagtccctgaggagcctgaccactgaagctgatcatgagatgactgtatgctgacacacccccttcaggggcctggccttgacttagggctgcactgtatcctcagcaacggccttgcaggagccccttttggactgctttccctattcagcccagagttggggtggtgggagaagaggggttggagtgaatccatctctattcaaattccagctgggattactctaggagtcttcctggcttgttttgggcccaaacttagctacattgtttattggctcccaaagtcgggattgaagagtgaaaagatgcaggcaatgaatccttctgcacactcctccccaacctttccagcgcttttctacttaggaggccagtggaagggaggagaggccatgccctagcccacaggggacaaggttcattgttcttccaggcttggttcactctgcttttgattcagaagctctttccctacccagcaagactacactttcttgccttctttctattttttctttttgtgcgtataaatggtatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgccaacacctgtttacttactacagttccccctccccccacattcctgacactagtaagaaccaataaacacttgttgacggaa

SEQ ID NO: 18950 - DNA, 1714 bp, Homo sapiens
tcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataatgcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaacca

SEQ ID NO: 18951 - DNA, 577 bp, Homo sapiens
aaaaacaccttgtgtaatgaaaaacccagatctataacctctccctatatattctgcatgcattgaagtaggctcaaaccctcagggacctggtatagacgcagaatctgtttcacacaacaactgctatttgaagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtg

SEQ ID NO: 18952 - DNA, 940 bp, Homo sapiens
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggctt

SEQ ID NO: 18953 - DNA, 1340 bp, Homo sapiens
cagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacctgtggtatatttataaataaaaatattaaatagaaggtaaaacaaatcag

SEQ ID NO: 18954 - DNA, 561 bp, Homo sapiens
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatga

SEQ ID NO: 18955 - DNA, 830 bp, Homo sapiens
aaaccctcagggacctggtatagacgcagaatctgtttcacacaacaactgctatttgaagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaaggttagtagttgcttcctgtgtttactaacaccgggctgtctccatggccctcttcagccttattacccaacctgtgtaatcagctccctccattaaatcccctctgtttgaaa

SEQ ID NO: 18956 - DNA, 566 bp, Homo sapiens
aaaaacaccttgtgtaatgaaaaacccagatctataacctctccctatatattctgcatgcattgaagtaggctcaaaccctcagggacctggtatagacgcagaatctgtttcacacaacaactgctatttgaagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcct

SEQ ID NO: 18957 - DNA, 567 bp, Homo sapiens
gtggtttggtagggtgagctggtgtgtggtgtggttggacctggcatggaacttaactggagtttatgtggaatgaaccttgagggccttttgtttaaactttgtgtggcctttttgtagtctttgtgtagcttttgtttttaagtggatcttcgctgaggactcatcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggagg

SEQ ID NO: 18958 - DNA, 1029 bp, Homo sapiens
gtactagctgtcagctgctggagaccttgctttctgtttcactgggaaacagaagcaatcagaaggaaacttcctcagactccacctctcccttcactcccgcctgtatccgtgcctgttacctggacgccttgtggaacttgaattctacgccctccactgggacactgcccttcatcctctctcacctcctccaggacaacactctctctgtggggctttcacccccatcgctccactgaaactgctcttgtcaaggtcatcgatgacctcccgctgacaaactcaactgtcccatctctacaccccaaactgacccatcaggaatagcatgagctccaccttccaaagcttccgcaatctcaccgtctccaccgttactacctgtgtccgaggcaccactgtttcttgcctggagttgtagacgggatttcaccgtgttagccaggatggtctcgatctcctgacctcgtgatccgcctgtctcgacctcccaaagtgctgggattacagaatgttgtagtcctcatcatcagcagagactttgtgccatcctctgctatattatcctgaagagtgcctggctcatgctccaggctgcggattttattgagagaacggagactgctggtgaactctcaagagggttaattggagttttatcaagccagatttcatggtgtctgcttaatgttaatctctccaagcttcccaccagactgcaaaggctgagctgcagtgttctgaatagcagtccagctatgaggggaggtgcccgtggcaggcctcagctgaccctggagaggccattaagacctggctgtcgcctccacagctgctcggaggcagagaaaggtggctttgtaagaagaaaagagatcattctttttccaccatgtgaggacccagcaagagggtggctgtctgcaaacccagggagagagccctcaccaggaatctgctggcaccttaatcttggacttcccagcctccacaactgtgaggaataaatgtatgttgtttaagcca

SEQ ID NO: 18959 - DNA, 1110 bp, Homo sapiens
atgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaattt

SEQ ID NO: 18960 - DNA, 3932 bp, Homo sapiens
tccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaata

SEQ ID NO: 18961 - DNA, 1193 bp, Homo sapiens
gcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggta

SEQ ID NO: 18962 - DNA, 1752 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggaca

SEQ ID NO: 18963 - DNA, 582 bp, Homo sapiens
cccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggacatt

SEQ ID NO: 18964 - DNA, 1279 bp, Homo sapiens
gcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtagga

SEQ ID NO: 18965 - DNA, 914 bp, Homo sapiens
aatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctgggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacattt

SEQ ID NO: 18966 - DNA, 976 bp, Homo sapiens
agacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtg

SEQ ID NO: 18967 - DNA, 2203 bp, Homo sapiens
ctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 18968 - DNA, 2222 bp, Homo sapiens
gcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaa

SEQ ID NO: 18969 - DNA, 1366 bp, Homo sapiens
ccaatctgtccgcggctgccgccacccaagacagagccagaatgttcaggatgctgaacagcagttttgaggatgaccccttcttctcagaccatgcaagcaagaagagaatggcatgaaatatataaagtgttgagaggaaaaaaacccactgacctagaattctgtatcctgcaaaattatcctttaaaagtcaagaagaaatagactgtctcagacaaacaaaaatttggtgaatttgttgacagtagacctgccttgcaagaaatgttaaaagaagttcttcagagagaaggaaaatcatacaagtcagaaactctgatgtacattaaaaaagcaagagcatcagagaataagttaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtg

SEQ ID NO: 18970 - DNA, 1266 bp, Homo sapiens
gagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttc

SEQ ID NO: 18971 - DNA, 1372 bp, Homo sapiens
gtttttccaatctgtccgcggctgccgccacccaagacagagccagaatgttcaggatgctgaacagcagttttgaggatgaccccttcttctcagaccatgcaagcaagaagagaatggcatgaaatatataaagtgttgagaggaaaaaaacccactgacctagaattctgtatcctgcaaaattatcctttaaaagtcaagaagaaatagactgtctcagacaaacaaaaatttggtgaatttgttgacagtagacctgccttgcaagaaatgttaaaagaagttcttcagagagaaggaaaatcatacaagtcagaaactctgatgtacattaaaaaagcaagagcatcagagaataagttaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtg

SEQ ID NO: 18972 - DNA, 1050 bp, Homo sapiens
gtactggaggctagctcttgtcgcggccgcggcgagttaacatcgtttttccaatctgtccgcggctgccgccacccaagacagagccagaatgttcaggatgctgaacagcagttttgaggatgaccccttcttctcagctaaccttgtttgtgaagggactccgctttctgtcaaaactagaaataggacagggaagctgatggggcggggcggggggaggggggcgggaggagggcggcgggggggggggggtgtgtatttaacacctcagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttga

SEQ ID NO: 18973 - DNA, 1247 bp, Homo sapiens
gggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaa

SEQ ID NO: 18974 - DNA, 1098 bp, Homo sapiens
agtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatg

SEQ ID NO: 18975 - DNA, 1958 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaa

SEQ ID NO: 18976 - DNA, 1379 bp, Homo sapiens
agccccggacgggagcgggcccacggggctgcaggtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatgg

SEQ ID NO: 18977 - DNA, 1110 bp, Homo sapiens
gcgaacggatggggccggggaagggagctgatgagggcgaggacagctcgacgcaatgccatgcaatgcccagcctcggctttttcgaaggctagtcctgccccgcttctaatttttaggaattcgagattctttcagtgtgtatgcgggaaggggacgatgaagagaaaagaaagctgaaagccagctgaggggagggaacgagaaaacagaggcggccgccgtccggggagagaagcgagcgacggtcgggccgcggggaggggcccggaggagcagcctccagggagagtcctgtttacacttgaggatctcaaaccgcttagcgaggaaagtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtga

SEQ ID NO: 18978 - DNA, 838 bp, Homo sapiens
agccccggacgggagcgggcccacggggctgcaggtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgta

SEQ ID NO: 18979 - DNA, 2920 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccaccc

SEQ ID NO: 18980 - DNA, 2385 bp, Homo sapiens
gcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaa

SEQ ID NO: 18981 - DNA, 2587 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaa

SEQ ID NO: 18982 - DNA, 14542 bp, Homo sapiens
atggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagagctaacaacacagatcccatgtagttggagaaccaaaggccacatacatgacaaaaagactgaaccgttcaggttacttgcatggagttggtgcttaaatgatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcaggtacagaagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcc

SEQ ID NO: 18983 - DNA, 14320 bp, Homo sapiens
atggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcc

SEQ ID NO: 18984 - DNA, 14244 bp, Homo sapiens
gcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatggaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcc

SEQ ID NO: 18985 - DNA, 13655 bp, Homo sapiens
atggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcc

SEQ ID NO: 18986 - DNA, 684 bp, Homo sapiens
gattttaaagatgagcaattcttaggttttggctcagatgaagaagtcagagtgcgaagtcccacaaggtctccttcaggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaag

SEQ ID NO: 18987 - DNA, 4320 bp, Homo sapiens
aacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagagctaacaacacagatcccatgtagttggagaaccaaaggccacatacatgacaaaaagactgaaccgttcaggttacttgcatggagttggtgcttaaatgatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaag

SEQ ID NO: 18988 - DNA, 16594 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcaggtacagaagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagttta

SEQ ID NO: 18989 - DNA, 4504 bp, Homo sapiens
ggttccgcggggctggcgggcgagcgggcggccgggatcggcggcggcggcggcggcggcggcgcttgacagacaatgagggcggcggggcggcgttgagcggcggcggcggcggcggcggcggcgagcgacgcggggcccgggggcggggcggggcgccagccatggacaatcagtgcaccgtccaggtgaggttagagctggggcatcgcgcccaactgcgcaagaagcccaccacggaggggttcactcacgactggatggtgtttgtccgcggccccgagcaatgtgacatccagcacttcgtggagaaggtggtcttctggctgcacgacagcttccccaagcccagacgcgtgtgcaaggagcccccctacaaagtagaggagtcggggtacgctggcttcatcatgcccatcgaggtgcacttcaaaaacaaggaggagccgaggaaggtctgcttcacctacgacctgttcctgaacctggaaggcaacccgcccgtgaaccacctgcgctgcgagaagctcaccttcaacaaccccaccacggagttccggtacaagctcctgcgggccggcggggtgatggtaatgcccgaaggagcagacacggtgtccaggcccagtcccgactaccccatgttacccacaattccactctctgccttctctgaccccaagaagaccaaaccatcccacggctccaaggacgccaacaaggagagcagcaagacctccaagccacacaaggtgaccaaggagcaccgggagcggccccgcaaagactccgagagcaagagctcctccaaggagctggagcgtgagcaggccaaaagctccaaggacacctcgcggaagctgggcgagggccggctgcccaaggaggagaaggcgccaccgcccaaggctgccttcaaggaacccaagatggccctgaaagagaccaagctggaaagcacgtcccccaagggtgggcccccacccccacccccacccccaccccgggcttccagcaagcggccggccaccgccgactcgccaaagcccagcgccaagaagcagaagaagagcagctcgaaggggtcccggagtgctccaggcacctcgccccgcacctcctcctcctcctccttctcggacaagaagccggccaaggacaagagcagcaccagaggggagaaggtgaaggccgagagtgagccccgggaggccaaaaaggccctggaggtggaggagtccaactcagaggacgaggcctccttcaagtccgagtctgcccagtcaagcccgtccaactccagctccagctcagactccagctcagactcagacttcgagccatcccagaaccacagccaaggacccctgcgctccatggtggaggacctgcagtccgaggagtccgacgaggacgactcttcgtcaggcgaggaggctgccggcaagaccaacccggggagggactccaggttgagcttcagcgacagcgagagtgacaacagcgccgactcctccctgcccagccgtgagcccccacccccccagaagccacccccgcccaacagcaaggtgtcaggccggaggagccccgagtcctgcagcaagcctgagaagatcctcaagaagggcacctacgacaaggcctacacggatgagctggtggagctacaccggaggctgatggcgctgcgggagcgcaacgtgctgcagcagattgtgaatctgatcgaggagactggccacttcaatgtcaccaacaccaccttcgacttcgacctcttctccctggacgagaccaccgtgcgcaaactgcagagctgcctggaggccgtggccacatgaccctgggccgcgtgccgggcccccaccgccggggtcctgggaggctgcagccaggcctcgcctgccctcctctcccgtctcgcctgcccgcagcactgccttagcgacagccctgtcctcgcccgcacagcccgctgcactttcctcggcggctccctgcccactctccccgctccatcgccaggagccctggggccgggctgggccacacgggagccgccccccgggctctctgggctcccctcagagagcggctggtgttgaaggcagctctgggcagagacagggccgggggcccctcgcccagccttgggaccagcccccactgctcggcgggctgtgcggcgtcgctgccccagcctttctgagcagcggatcgacggctggggggcatctccagcctcccgaatggttcagaacacaccctccgcccaccctggacctcagaaggccctgcctgtgtgtctgcgtcgtcctccgtgtagacctagcgccggctcctccccggctcgcgctgcgctggggtctgtgctgtatagttctctctattatatatgtgtgtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagc

SEQ ID NO: 18990 - DNA, 4072 bp, Homo sapiens
aacagccttgagatgagatcacacaaacactcaaatgtagcttctaggggaggggagaacccaggaggctgggctttctcttctcttctcaccactggaagggaggagtaaccagaaggagcggaagctaaaacacgctgtccagagaggggagctgtggtcagtgggacgtcagtgagtcagtcatagggtttgtcctgatggtggtggtggcaggtggtaagggttggggaaaaatgaagaattagaggaaacccccaacaccagcaggcaggctgtactgtgactggactctccctcaacatcccccactctgctcaaagctgagggacagaggtggatagtgctgggagggaagagaagagagggggaggagaaggagagagggaaaggggcagtggagagaacaaggccatttctgtttcttttccagggacctgaccagagctgggtggagggaaagcgtgtgtgtgggacttggcatgaaatgaccaatgatgacgagaagtgaccaggaaattccattccctaggacattagggtctctgaaacttgagggtggggtcagagtgtgaagaagacaggtcagggtgaatgtgatggtagcgcagggcagtgggggatgggaacaaagccagaaaaggaagtaagagccactggcggccactcttctttaaagcagccagaagagagtgggttgaggaaaaatgaagtcctgagctggtcagcccaggcggaagagccacccgaatccaaccccacagtgaatagggaaggggctgagaaaacaacaggagggatgaggattagacctcataaggccacgtcctgagagccaagtggtgctcagaactcgacctctctgagttccaaatggcaagagtgaaatatggaaccgggaaagccaccccccgcccccaccaagatcatactaggacttgagggtctcagagctgttgggaggtgagcagaagggatgggaaagaggtgccagggaggaaggatgtacaggctagttctctggtcctgttcgggccccaaaccggttctcccggtcccaccgcctctggccctaaggcctccaacccgcggcctgacaagccctcacatgaagcagctggagagaaagaaagaatcgagagaatggcatgggcaattctggctagaagcccggggcagcagctggtccctgtgtggagaccccgagacatggagggctgctgagggactctggagaagcggtgtggactccatatttcagccaagtgacaggcccaacaccaaccttcccttccccaggaaaggtcttctgggggcttaagaggaaagagggctaggccctaagcctcccctccccaaatatattcaatcacacagattccgtatctgtctccccccactacacaactctacctagaagttctctgctgttctcaacccttaaccggactgggacctctctgggaatctttcggaccctctccctcccacctcccccaacattccagttccttcttttccttctactcttcagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagcccggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatccca

SEQ ID NO: 18991 - DNA, 3367 bp, Homo sapiens
acggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaagtgtacctgtaaatgtcctgaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaattcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattatttttaaaagaaaaaaaccaaagtacttttggtgtcattattccatcttctccataagtggagaaatgaaaagtaagaacagctcatcttcaaagtttttactagaaattc

SEQ ID NO: 18992 - DNA, 708 bp, Homo sapiens
tcttaacagctctccattccttgctgacacacatgaacttaggggcacttctgttttcctgagggctacaccgttttcttttgaaagagtctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgtt

SEQ ID NO: 18993 - DNA, 1983 bp, Homo sapiens
tcttttcaagaagatcattcttaacagctctccattccttgctgacacacatgaacttaggggcacttctgttttcctgagggctacaccgttttcttttgaaagagtctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaagtgtacctgtaaatgtcctgaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaattcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattatttt

SEQ ID NO: 18994 - DNA, 6772 bp, Homo sapiens
gaggctcggagcccgggtgtcaggcgccacggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaagtgtacctgtaaatgtcctgaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaattcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattatttttaaaagaaaaaaaccaaagtacttttggtgtcattattccatcttctccataagtggagaaatgaaaagtaagaacagctcatcttcaaagtttttactagaaattcagccgaaaagaagagaaatgaagaaatacttctggatccaaaggttcgtcactggatcagccttaagaaagtctctatgtgtgctaatagaccagtatctcccttgtttgttcccatgccagatgctgtcttttcatacagagattaactagtgtctgtacagaaaatggtctttccagacccattcttttgggcagttatataaatgcagattgataatggagttatttctgcattttaaaaaggggattttttacactgtttctttctatccaaagaaactatttttcctttaaaaaattataatacagccatgctccttgtaaattatttctctgaagcgtcctcccagaggacaagtgtactttctcaataatgttatgattcttaatgacgattggcatgaaccgtacttgaagcatttgttgtattgtccacttcttgatgtgcagagaaactttgagtcattttggacattaggtgattgatgaattgtgtggtttcagttgcgttttgtttttaactttatagctggaaggggagggtaatgtttatatggaaatgttgcaaatttttaaaatattttaaaatttctaactgctaacacatattctgatcaagccagaagtttatgtgatttaatatatctgtgtagtttaactagaaacgtatatatgtagtttgggccatttttatttctgtaactaaattgtggggcaaaaaatatgatttgccaatgtaaaaattttttcctttaagttactaaccaagaagctaggtaagataagaaatgaccaaacaaaaataatgataagaaggacagctattatatgataaactttagacttgaaaattaggtaataaagttaatttcttcagaatatcctaaaatgtaagtttgtaaattgataaagttcagaaaaacttatccatcttctactcatcaagatagcaaagtaagtttttcacaaaattaagactgagagttacgttattttttttgaagtggtaatcttgctctcatctaatttttaaatacagaaataaaaagatccctttgaattaatttcaagtagttttaatacctctcttaaagtaaccccttcagttctgtcacatttatatacacccaactttgaagcctattaagaatatctttgacatgtgagtaccctaacagtggctctggtttcttaagcacaaagggaaaatggcagggtttaatttctttggtgtacatatataaatagatgtttcaaataaaattaattgggtaaatgtgaatatggtttgaaccagccagagtatgataaacttttaaaaaatttttcctcagtgatcagccaggggaaaaaatatatgtacagagctcctgcccctctgcccccttataacttagcttttgcctctggttttgcagcaggatgtgtgttggtgggtttggggttccttctgtcttcggatgtaacagtcatgttagcaacaatattttgcagttacttcaccatcctcagcataatctgcctctctctcaatcttaatacagacaaataggtatgtctataaatgcgttcatatagtgtcaaggtagggaagactataaaaacttcagatcaggaaaaaaatatctcttaagagagtgtcttaaacattttaaattgctaggcaatttaaatctctctaatctgaatattcaccttttggtggaaagagccagtaatattggttttcttccactaaaaagtttcttcaaaatttttttttttttttttttttttttttttttgccgatatcttttacaggcccacctaatctttaaaaaaaagagaagaaacaattttaggcctgtataacatcctatttactacttcaagctccacaaatgtagttaatatatttgtttaagagagactttactcttaaatgttttaactttgcctacttaatggagttggatgtccagtgttggaaacagtcagtgtctgtttggtggctcgtgtttatttttgtcactgtagaagtgatctgctctggagtaatttgctgtatgcttattactttccacctttagcgttttgtgtactaatgctatgtactgctcctatatttatatatacatatatatatatatatacacatatatattatcagagtaatcttgctttggactgttgctctaaaactatgaatatgatgtagagactactacagctgcagtgaatgttaaggagtcaattcccatggtttagtttagtctcgggctggaagtctacatcttttgacctcttttgttttatatgatgctttttattatgtaggcactgccatccctgaatattccttgtaaagatgcagtgaagaagtcaatttaaaaggaagacaaagccaccgctgtctgtaaactgtaaatgtgtattttggcacttgtactccagtattctgaaaatagagttatgatggaaatgctgacagatccttaatggtggccagagctaccatgcagtgcaaaaataaattaagtgaaaatgtattattgagattaacagtgcaaggccaatacattttataaatctgtcagtatctttttaatggactgtgtatgtgtagttatgttgaaagatacattgtgtatgtgtacatgcttttgtgtgaattcaaggcacactgtaagatgtatttcccttctctaaaatccatgttgaaatgtaagtacagattgatagaaataggtgttttacttaaactcatataatctgtttcagcaccttttttaaaatgtataattgtactgatttgctgagagtcatttgaccaaagtttggctttattttgcatacaggaaaaattagcccctagccttttctcaagaagtgatgctgtttctaaagaagaatagatggggagatctgagacatccagagagaggacaatgtgtccaaaaccagctgaaggcagagagtccatgcctcattcattttaggagtccctcatgtctaacaccatcttctgtgtcctaaagccagtatatatataatatttttaaaactctgcaaagattggaacaagaagtggtgggatacattttttggcataaactgggctatgtgtgcccggtattttttctttcccccctatttctttggagggttttgttcagaaacaatgtgctatagccagagagagtcgatcttacaaagtccctgcatttactttcacagcaagaactgctaccttgattagacaggaaggagaacaactactacaacaaagagaataaaatacattcagtttggtaaataaccaa

SEQ ID NO: 18995 - DNA, 2040 bp, Homo sapiens
atatttcagccgccgccgccgggagctgcgggcacagtccggggacgcggcgagcagcctcggcggccgcacctccgcaaagcgccgcggccgctacgatgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaa

SEQ ID NO: 18996 - DNA, 2070 bp, Homo sapiens
gcatttgttgtcgtgcttgtcgtggctgagtgtgttctccctcttttccccgacccccttcccgactggggataacattccgttacaatcctgtccgatgtagatgcggggcccggggcgcctggggccaagccgggccgggcgggcgggtatatttgggggtgtggagtgtgcgcgcccacgcgcgtgaaacgtggatgcagagggcaccgccgtttccttttatgtgcgtttcaagaaggaggaaaaaatgtcaggcgcaacgttcactgccgaaacctcgccttcctgttattcacggctgtctctcctccccctgcccgcagtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttgg

SEQ ID NO: 18997 - DNA, 7740 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggcaattcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggcagactgctatgccagcaatctctgttctagatttgttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatg

SEQ ID NO: 18998 - DNA, 5249 bp, Homo sapiens
ccaggcggaggccaagtcggaggacgcggcgcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggcagactgctatgccagcaatctctgttctagatttgttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttct

SEQ ID NO: 18999 - DNA, 7704 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggcaattcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatg

SEQ ID NO: 19000 - DNA, 6812 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgagggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttcttaagaagcacgaggcagagcagggcctggctcccccagctttgtgattggacctgcaactttaccccatctggcccacctacctctcttctggactgtctccagatccccttatctgccaagttttgtctccttcaaacttctgaactcttgggcgtgtgtagcagtgagcctctttgcaaagggttcgtttcctcgggcactcatctttactgaacatggcccagcttgtcattgtgaaggtgacattggttcagtgattgcttaaatggcatgtggaccgtgggaagcagtaggagcgtagtaagacagttggctgccattcaacatttcaaatagatggtttactcaaatcactcacttctggttgatggtaaagagagcagatggcttagaaaacatgatacaggaaaatttagtatgtaatccagtaaatatcctaagttatttattttcatgtgtgtgtgtgtgtttaaatcaagtaacccttttaattgaattttaaaatgacagcgaattttgacattctgagaaatggggattttgagatgtttctctccatatctccctttgtcctgtgtgtgtggccgacgccctctggatgaagaggctgtagccgttgagctccctgtgggggcctgtttcatcccgaggggactgcgtgttgctctgtgtggtttgagagaagctgctcttctctgttacttcccttctatgaaggtagaagctttcagtgttacaacttctgatggcggaaaatttagtttttattaataattccttcttggatagtctagtgaactatattaatagaacagtgtactgttcacagaaaagaacttgtagggagttttttgtagtgatatgctctattaggatacagaacaatctaagagtaagcttgatagacatgatgtgacttcacttaaatggagtagagtgaataatgtaaggacactcacctctgttgaaattggtgatttctgcattttgtagacctttgccctctaagtttatcatcatattatctgttgaatctgaacagcatttgaagtcctctcaaagagtttgagctttcaggattaggttcccctgtgagtctttcacttgtgtaatggtaagtcaacattgatgatctttctaaggaaatcagatttacaaaatgctgagccgcttgatgtctaagtgttggtggtttttgctgttgctttgctgttccatgaaagcgctccctggctgcttggagggctgtgcttttccaggtcagtgccagcttggctgtcccaggccgtgcacagtgcccattgctatagctgggcccagtcctggccacgccggagcctcggcgggggcagctgggttgtcacggcagcacagtgcacatgcagagaggaccaggccatgtttttcctgtgctgagaaactcttgggttatttaatttttccaatgtgttttcataactcatgattatttgaaatacacttgtgttagtaactgcttctataattaagtggtcactgtaaaaaggcgaataacctatttttatatcagaatgtccaaaactcatgggtttgctttgttatagaaaaatgtgccattcatttgttgggtagaataaagttgtcttgtaattgt

SEQ ID NO: 19001 - DNA, 7461 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggcaattcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatg

SEQ ID NO: 19002 - DNA, 5475 bp, Homo sapiens
atgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtga

SEQ ID NO: 19003 - DNA, 7578 bp, Homo sapiens
gcgcgcggccccccgctccctccctcccccctgacccccgacccccgccggccggccccccgccccagccccggagggagctcatgggagtatgaaggagatggtaggaggctgctgcgtatgttcggacgagaggggctgggccgagaacccgctggtctactgcgatgggcacgcgtgcagcgtggtcgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgcaaaaaaaaaaaaaaaaatccgaaga

SEQ ID NO: 19004 - DNA, 2724 bp, Homo sapiens
gcgcgcggccccccgctccctccctcccccctgacccccgacccccgccggccggccccccgccccagccccggagggagctcatgggagtatgaaggagatggtaggaggctgctgcgtatgttcggacgagaggggctgggccgagaacccgctggtctactgcgatgggcacgcgtgcagcgtggtcgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaagcctagaaggggccaccaatcaccgaccaaccatgggattgggagtttggggtgctgtctgccagatactcccatctgcctctgtccagagggcctcagccctgggctcttgtctgcagagagtgggggacggcactcaggcctgctctccaagttctagggcccctgtccccagagatcggtagaggacatcccctacgccccatcaggaggacacccaaagcttgtcacccaacccaaatcccactctgtgcaggttggaggggctgaaagttctgaccaaggtggcatggggggcaggcccctggacagtatcccgaaactcccactcatcccaccattcccagcagggcatggtatgtcaggcctgtctccagaaatgggcaacatctggctgagcgataggcaggccctaccctaggccagggaattgctaatccaagctggaacagccctccctgctccctacaacctgccctccccatgggaggagaacctggtagggtggggggagatggagaaactgctccctcctgtcaccattattgcccattcacctccaccccatctcagacggttggcagagttctgggcaccttagcaggaggttcaggtatcaggtttccagggtgatgttgctgtggcaactgccccagtaaacctctcccctgcttcccagggctcacctggagaccttgtcattcatgccctctgacctttccaggggcctgcaggcaggtggcaagaaatggccaggggtctgggagtttttccagtaactggatgtcccttggacatgccagagaactctgcccatcctcctccactcgccccagcacttcggctacccttccccccagcccctctcttcccttgctctcagaaccacatctggctcccttcagaactccagctgttgaaaagaacaaagaggaagacagagaccaggactccgcccgggaggggcagtgcagggtggctctcgtttctggtccagcctgcattcagcatttatctgttcagcacgattaactgaatacctggtcgctactaggaggaaaagggccttccctggcagcagcctgaagcacgaacgaactcacggcatgccaggctgtgttctagaaccaggagatggaggggcatatggagattagtccatttaatactcaaaataatccaattaggttggaaatttataaaccccatttaatatatgaagatgatggggcacagggaggttaagtaatttgcctaaaagcacacagctagtaaagtggtagacctgagattccaatgcagtctggcttgaaggcttgtgctcttcacctgcccacagcactgtctctgcagctgctgccactggacgtctcatcatttattgaccctataccatgtatctggcatcatgctgcttccaactcaccacatatgcatagtgctccctgtaaagacactgacacttatcgacgttgagactttgcacagtataacatggcagtgaggccaggcgtggtggctcacgcctgtagtcccagcactttgggagtccgaggcaggtggatcacctgaggtcaggggttcgagatcagcctggccaacatggtgaaaccctgcctctattaaaaatacacaaaattagccgggtgtggtggctggtgcctgtaatcccagctacttgggaggctgaggcaggagaatcacttgaacctgggaggtgattgaaggttgcagtgagccgagatcgcaccattgcactccagcctgtgcaacaagagtgaaactccatctcaaaaataaattaagaaaaaacaa

SEQ ID NO: 19005 - DNA, 19419 bp, Homo sapiens
atggacagccagaagctggctggtgaggataaagattcagaaccggcagctgatggacctgcagcttctgaggacccaagtgccactgagtcagacctgcccaacccacatgtgggagaggtctctgtccttagttctgggagtcccaggcttcaggagactcctcaggactgcagtgggggtccggtgcggcgttgtgctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccatcatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagactgagaaagtttcagaacctgaatgcccagccttggaacccagtgccaccagtcctctcccttccccaatgggggacctttcctgccccgcccccagccctgccccagccctggatgacttctctggcctaggggaagacacagcccctctggatgggattgatgctccgggttcacagccagagcctggacagacccctggcagtttggctagtgaacttaaaggctcccctgtgctcctggaccccgaggagctggcccctgtgacccctatggaggtctaccccgaatgcaagcagacagcagggcagggctcaccatgtgaagaacaggaagagccacgtgcaccggtggcccccacaccacccactctcatcaaatccgacatcgttaacgagatctctaatctgagccagggtgatgccagtgccagttttcctggctcagagcccctcctgggctctccagacccggaggggggtggctccctgtccatggagttgggggtctctacggatgttagtccagcccgagatgagggctccctacggctctgtactgactcactgccagagactgatgactcactattgtgcgatgctgggacagctatcagcggaggcaaagctgagggggagaaggggcggcggcgcagctccccagcccgttcccgcatcaaacagggtcgcagcagcagtttcccaggaagacgccggcctcgtggaggagcccatggaggacgtggtagaggacgggcccggctaaagtcaactgcttcttccattgagactctggtagttgctgacattgatagctctcccagtaaggaggaggaggaagaagatgatgacaccatgcagaataccgtggttctcttctccaacacagacaaatttgtcctaatgcaggacatgtgtgtggtatgtggcagctttggccggggggcagagggccacctccttgcctgttcgcagtgctctcagtgctatcacccttactgtgtcaacagcaagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtggatgcatgcaggctgtgagagcctcttcacagaggacgatgtggagcaggcagccgatgaaggctttgactgtgtctcctgccagccctacgtggtaaagcctgtggcgcctgttgcacctccagagctggtgcccatgaaggtgaaagagccagagccccagtactttcgcttcgaaggtgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggtggtgtggagcacatggagtgcgaaattaaactggagggccccgtcagccctgatgtggagcctggcaaagaggagaccgaggaaagcaaaaaacgcaagcgtaaaccatatcggcctggcattggtggtttcatggtgcgacagcggaaatcccacacacgcacgaaaaaggggcctgctgcacaggcggaggtgttgagtggggatgggcagcccgacgaggtgatacctgctgacctgcctgcagagggcgccgtggagcagagcttagctgaaggggatgagaagaagaagcaacagcggcgagggcgcaagaagagcaaactggaggacatgttccctgcttacttgcaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggagatgatggtccagatattgcagatgaagaatcccgtggcctcgagggcaaagccgatacaccaggacctgaggatgggggcgtgaaggcatccccagtgcccagtgaccctgagaagccaggcaccccaggtgaagggatgcttagctctgacttagacaggatttccacagaagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtggactccctttgggcaatctgccctccagcagcccaatggactcctacccaggcctctgccagtccccgttcctggattctagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcacctgtgctctatgccaacattaattttcctaatctcaagcaagactacccagactggtcaagccgttgcaaacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagtgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccattcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgccagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggccagcaggtgagctccatgccaaggtcccaagtgggcagccccccaattttgtccggtcccctgggacgggtgcatttgtgggcaccccctctcccatgcgtttcactttccctcaggcagtaggggagccttccctaaagccccctgtccctcagcctggtctcccgccaccccatgggatcaacagccattttgggcccggccccaccttgggcaagcctcaaagcacaaactacacagtagccacagggaacttccacccatcgggcagccccctggggcccagcagcgggtccacaggggagagctatgggctgtccccactacgccctccgtcggttctgccaccacctgcacccgacggatccctcccctacctgtcccatggagcctcacagcgatcaggcatcacctctcctgtcgaaaagcgagaagacccagggactggaatgggtagctctttggcgacagctgaactcccaggtacccaggacccaggcatgtccggccttagccaaacagagctggagaagcaacggcagcgccagcgactacgagagctgctgattcggcagcagatccagcgcaacaccctgcggcaggagaaggaaacagctgcagcagctgcaggagcagtggggcctccaggcagctggggtgctgagcccagcagccctgcctttgagcagctgagtcgaggccagaccccctttgctgggacacaggacaagagcagccttgtggggttgcccccaagcaagctgagtggccccatcctggggccagggtccttccctagcgatgaccgactctcccggccacctccaccagccacgccttcctctatggatgtgaacagccggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgagaaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggaggaccaccagctcacctgctgacccccagcccactgagtggcccaggaggatcctccctgctggaaaagtttgagctcgagagtggggctttgaccttgcctggtggacctgcagcatctggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgtctgcaccaggccctgcccaggccatgtctttgccacatgagggctcttctcccagtttggctgggtcccaacagcagctttccctgggtcttgcaggtgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacagacctggacaaatttgctgcagaagatatcattgatcccattgcaaaggccaagatggtggctttgaaaggcatcaagaaagtgatggctcagggcagcattggggtggcacctggtatgaacagacagcaagtgtctctgctagcccagaggctctcggggggacctagcagtgatctgcagaaccatgtggcagctgggagtggccaggagcggagtgctggtgatccctcccagcctcgtcccaacccgcccacttttgctcagggagtgatcaatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcccaacagcagcaacagcaacattctggtggggctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccaggggccccagggcatgctgggccctgcccaggtggctgtgttgcagcagcagcaccctggagctttgggcccccagggccctcacagacaggtgcttatgacccagtcccgggtgctcagttccccccagctggcacagcagggtcagggccttatgggacacaggctggtcacagcccagcagcagcagcagcaacaacagcaccaacagcaagggtccatggcagggctgtcccatcttcagcagagtctgatgtcacacagtgggcagcccaaactgagcgctcagcccatgggctctttacagcagcttcagcagcagcagcagctgcaacagcaacagcaacttcagcagcagcagcagcagcagctacaacagcaacagcaacttcagcagcaacagcttcaacagcagcaacagcagcagcagcttcaacaacagcagcagcaacagcttcaacagcagcaacagcagctacaacagcaacagcaacaacaacagcagcagtttcaacagcagcagcaacagcagcagatgggccttttaaaccagagtcgaactttactgtctcctcagcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcaggcagtacgccagaccccaccctaccaggagcctgggacccagacctctcccctccagggcctcctgggctgccaacctcaacttgggggcttccctggaccacagacaggccccctccaggagctaggggcagggcctcgacctcagggcccaccccggctccctgccccaccaggagccttatctacaggaccagtccttggccctgtccatcccacacctccaccatccagccctcaagagccaaagagaccttcacaattaccttcccccagctcccagcttcccactgaggcccagctccctcccacccatccagggacccccaaacctcaggggccaaccttggagccgcctcctgggagggtctcacctgctgctgcccagcttgcagataccttgtttagcaagggtctgggaccttgggatcccccagacaacctagcagaaacccagaagccagagcagagcagcctggtacctgggcatctggaccaggtgaatggacaggtggtgcctgaggcatcccaactcagcatcaagcaggaacctcgggaagagccatgtgccctgggagcccagtcagtgaagagggaggccaatggggagccaataggggcaccaggaaccagcaaccacctcctgctggcaggccctcgctcagaagctgggcatctgctcttgcagaagctactccgggcaaagaatgtgcaactcagcactgggcgggggtccgaggggctgcgagctgagatcaacgggcacattgacagcaagctggctgggctggagcagaaactacagggtacccccagcaacaaggaggatgcagcagcaaggaagcctttgacaccgaagcccaagcgggtacagaaggcaagcgacaggttggtgagctcccgaaagaagctgcggaaggaggacggggtcagggccagcgaggccttgctgaaacagctgaaacaggagctgtccctgctgcccctaacggagcctgctatcaccgccaattttagcctctttgccccctttggcagtggctgcccagtcaatgggcagagccagctgaggggggcctttggaagtggggcgctgcccactggccctgactactattcccagctgcttaccaagaataacctgagtaacccgccgacaccaccctcgtcgctgccccccaccccacccccatcggtgcagcagaagatggtgaatggcgtcaccccatctgaagagctgggggagcaccccaaggatgctgcctctgcccgggatagtgaaagggcactgagggatacttcagaggtgaagagtctagacctgctggctgccttgcctacaccccctcacaatcagactgaggatgtcaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggccagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagccaagaacctgaatggcgtgatggtggcagtggcggagctgctgagcatgaagatccccaactcctatgaggtgctgttcccagagagccccgcccgggcaggcactgagccaaagaagggggaagctgagggtcctggtgggaaggaaaagggtctggaaggcaagagcccagacactggccctgattggctgaagcagtttgatgcagtgttgcctggctataccctgaagagccaactagacatcttgagcctcctgaaacaggagagccccgccccagagccacccactcagcacagctatacctacaatgtctccaatctggatgtgcgacagctctcggccccacctcctgaagaaccctccccgcccccttcccccttggcaccttctcctgccagtccccctactgagcccttggttgaacttcccaccgaacccttggctgagccacccgtcccctcacctctgccactggcctcatcccctgaatcagcccgacccaagccccgtgcccggccccctgaagaaggtgaagattcccgtcctcctcgcctcaagaaatggaaaggagtgcgctggaagcggcttcggctgctgctgaccatccagaagggcagtgggcggcaggaggatgagcgggaagtggcagagtttatggagcagcttggcacagccttgcgacctgacaaggtaccgcgagacatgcgtcgctgctgtttctgtcatgaggagggtgacggggccactgatgggcctgcccgtctgctgaacctggacctggacctgtgggtgcacctcaactgtgccctttggtccacggaggtgtatgagacccagggcggggcactgatgaatgtggaggttgccctgcaccgaggactgctaaccaagtgctccctgtgccagcgaactggtgccaccagcagctgcaatcgcatgcgttgccccaatgtctaccattttgcttgtgccatccgtgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtggggggccttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccaggccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcactgcccggggtggagagctgtcaaaactatttattccgctatgggcgccacccccttatggagctgccactcatgatcaaccccactggctgtgcccgatcagagcctaaaatcctcacacactacaaacggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttccccaccaccggccctcaggctggcatctctgcccccagctccaggaggggccagacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaa

SEQ ID NO: 19006 - DNA, 636 bp, Homo sapiens
ggggggagggtggccactccgacctggatttaccgttcttggcccccctaagcccccccgtgcggggggcggctgtgatcgctctggcggttggaggtcggggagcggcccgggctctggccatgttctcggatgaggatttctggatcgccctgtgaagaggtctccccgagagggccctgcccagtcggagagagggatggacagccagaagctggctggtgaggataaagattcagaaccggcagctgatggacctgcagcttctgaggacccaagtgccactgagtcagacctgcccaacccacatgtgggagaggtctctgtccttagttctgggagtcccaggcttcaggagactcctcaggactgcagtgggggtccggtgcggcgttgtgctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtc

SEQ ID NO: 19007 - DNA, 16862 bp, Homo sapiens
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttgtctcagggagcacagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaaccagttatgaaatcagtaccaaccaatggctggaaatgcaaaaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtgggttcacctagagtgtgacaaaccaacagatcatgaactggatactcagctcaaagaagagtatatctgcatgtattgtaaacacctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctataa

SEQ ID NO: 19008 - DNA, 17029 bp, Homo sapiens
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttgtctcagggagcacagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaaccagttatgaaatcagtaccaaccaatggctggaaatgcaaaaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtgggttcacctagagtgtgacaaaccaacagatcatgaactggatactcagctcaaagaagagtatatctgcatgtattgtaaacacctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacaggtgaggcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatct

SEQ ID NO: 19009 - DNA, 5874 bp, Homo sapiens
ctcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatt

SEQ ID NO: 19010 - DNA, 4835 bp, Homo sapiens
taatcagaggtccctctcgatcaactgacgtagcttcatttcattcttttgaatggttacctgatgttccatagtgttgatgaactgcagttaaaccattgcattactgatgagtgtgtatttgatttataatttttctcataacaaacagtgttgctatatcttgtacaaatatcacaatgaattaatagtttcactcctatggggtatattcccaaacgtgaggtttctgtgtaaaagcgtgtgtacttttcatttaaatagatattgccagttttctaaaaagtctcttactgcacacttcttcctgcagcatgtgagactgttttcttgtttcccatttgtagctggtgttactatttttttgtttagttggtctgataaatatagactgatgttaccttaattgaataggcagcttttcatgtccgccatttggatttgctttcataggaattgcgtattcatatcctttgtccatttttcaatttttagcagtttacactattcagaattttcccctacaaaatatcctttgcctaccagcaagtgtgacatcttttttcttgtaaaagttactgtttatataaacaaacatacataattttctgttgcatctagtcttggtcaagaccctagattatatacggattctagaggttttcttgcataacatttttaaaatacaatttcgctttcttccattggataaccagttgttgaagggccatttagaagtaacccactcatttttaactgattttctttcttcttctttgagacagggtctcactgtgtcgcccaggctggagtgcggtggcacaatctcagctcactgcagcttcgatctcctgggctcaagcgatcctcttacctcagcctcctgagtagccagggctacaggcgcatgccacaatacttggctaatttttaaaaatatttatttagagatgaggttttgccatgttgtccaggctggtcttgaacttctgaactcaagcaattcacctgcctcggcctcccaaagtgctgggattacaggcatgagcccccgtggctggcatgaattttttttttttttttttttgagacagagtcttcctctgtcacccaggctggagtgcagtggcacgatctcggctcactgcaacctctgcctcccaggttcaagcgattcttctgcctcagcctcccaagtaactgggactacaggtgtgtactaccatgcccggctaattttttttttttttttaagtagagatgggatttcaccatattggccaggctggtcttgaactcctgacctcaagggatctgcctgccttggcttcccaaagtggtgggattataggcatgagtcaccacgcctggcccatttggaatctcttcatttccactgatcttgtttattcttaaaccacactctattgatctccatacatactttttgtgtgttctggttcattcacttgtgagttgtatctggagtagaacagataatcaaagatgcttgttcagaggataaatcagttcacatactaaagtctctcacatggcccttcccaccatgtgctcccggatgtgcttcatgaggatgcagctggggcagcacatggtcctcctagtaattccgactagaatgcagttgatttctgcattctagaattcagttcaattctagaattgcattctagtctagtacttctgattcagttgcatctagtctagtacttttgcattcagttgccttctagtcagaattaagtgcaaaaacccaaaattgggacaagaaaatacaactatttatggcaaagacccatattttgttagtatgtttctctacaagttgtgctaccaacctgaatagtgcacctggcaggccaccagcacgggagtacaagctgcgcagtgagagctgcttccatttcagcccgttcaaacttctttcccagcctcagaattttgtattagtgaaaaatttaccttccccaagagcttcatttgtttccaacattcctgatatttacagcagagtgacgtttcctgtgtctgctctttgccctggctgctgggaaactcagagccaagtctgaaccctgtttacagtatcagtgattggttatagttagcctgatttctatgttattgaatttattatgtcttttttgaaatagtattggggtaaaataaacaccacaagtcaataagcttatttagttggtgggaactcagctatctcatctggaaggttagatagcctaatacataagacagccaagccacagtactactttatacatagactctaagaatttagtgctaaaaaagatgtaggaataagctagtgatggcatagttttaagtagtaaaaatgtccaatttttaaaatttcagaaaatagcatattcaaaaatgatttgagttcaagtgaaacttaagtatggcttctaataagacccgagggtgaaacctttgtatgaaaaacagaaaaaagacttgttgtcacataaattggaagtatgtacacacttttttttaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatct

SEQ ID NO: 19011 - DNA, 6714 bp, Homo sapiens
cgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagtttt

SEQ ID NO: 19012 - DNA, 6874 bp, Homo sapiens
gccgccgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagtttta

SEQ ID NO: 19013 - DNA, 7013 bp, Homo sapiens
cgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaataca

SEQ ID NO: 19014 - DNA, 5139 bp, Homo sapiens
cgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacactcaaaggtag

SEQ ID NO: 19015 - DNA, 6899 bp, Homo sapiens
cgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaaacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaataca

SEQ ID NO: 19016 - DNA, 5496 bp, Homo sapiens
cgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaa

SEQ ID NO: 19017 - DNA, 375 bp, Homo sapiens
tggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgaccctgatcctgaaaatccagaacccacaactacgaatgaatgtccatccccagatacttctcaaaatacttgtaaaagtcctccaaaaatgagcaa

SEQ ID NO: 19018 - DNA, 617 bp, Homo sapiens
cgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgacggagtctcgctctgtcaccaggctggagtgcagtggcgcgatcgcagctcactgcagcctctgactccctagttcaagcgattctcctgcctcagcgtcctgagtagctgggattacaggcacatgccaccaagcccagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcct

SEQ ID NO: 19019 - DNA, 2520 bp, Homo sapiens
gtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatggtaagttgggaagccagtagtttgggcttagtgacagctgctctgcatatggtaattgttgctgcctttacatgggcttttacattattctttgaagttagcgaatgatgtgccattgagcatttttatttggtttggtcattgccatttaaataaattccattaatcttgtatttttattggttgttcattagagatttaagaatgtatgacatttaagaaatatgaacattttggaagtaataatattttaataatgccacactgaactattaataaattttaatgccac

SEQ ID NO: 19020 - DNA, 1133 bp, Homo sapiens
gcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaa

SEQ ID NO: 19021 - DNA, 1588 bp, Homo sapiens
ggaccataattatggtgctcgtcctctccgacacctccgcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaa

SEQ ID NO: 19022 - DNA, 3047 bp, Homo sapiens
accaggccccgcccagcggccgcagccagccaggccgcgcccgggacgactgcagagcgcggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggt

SEQ ID NO: 19023 - DNA, 1492 bp, Homo sapiens
ccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccc

SEQ ID NO: 19024 - DNA, 3186 bp, Homo sapiens
gccgactcgaagcccttataaggcgcggagacaccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggtaaaagaa

SEQ ID NO: 19025 - DNA, 3056 bp, Homo sapiens
agacccttccagctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggtaaaagaagg

SEQ ID NO: 19026 - DNA, 3111 bp, Homo sapiens
agacccttccagctgccgctgtcgtctttgcttcagccgcagtcgccactggctgcctgagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggt

SEQ ID NO: 19027 - DNA, 592 bp, Homo sapiens
gcctgttccaagtgtggcttaatccgtctccaccaccagatctttctccgtggattcctctgctaagaccgctggttgcccaggctggtctccaactcctgggctcaagcaatcctcctgcctcagcctcttggagtgctgggattacagccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgc

SEQ ID NO: 19028 - DNA, 1376 bp, Homo sapiens
agacccttccagctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcct

SEQ ID NO: 19029 - DNA, 1009 bp, Homo sapiens
ccactcctggactcggcctccacccctgggcttggcctcaaagcctcctcagttgtcggccctggaaggtgcccagcggcggcagcgccagacgcgccccgttagctcagcgtcgctgagcatccgcagccgccaccaggccccgcccagcggccgcagccagccaggccgcgcccgggacgactgcagagcgcggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggc

SEQ ID NO: 19030 - DNA, 841 bp, Homo sapiens
agacccttccagctgccgctgtcgtctttgcttcagccgcagtcgccactggctgcctgagccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccc

SEQ ID NO: 19031 - DNA, 777 bp, Homo sapiens
agacccttccagctgccgctgtcgtctttgcttcagccgcagtcgccactggctgcctgagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcg

SEQ ID NO: 19032 - DNA, 2287 bp, Homo sapiens
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcaggacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagccggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 19033 - DNA, 1996 bp, Homo sapiens
cttgccttgattctcctgttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcagagtccattcaggagcaggaaagttcatctcagaccctaaatccagccacgtcatgccacgcttaacacctctaacaacttcccctggcacttaggacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagccggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtc

SEQ ID NO: 19034 - DNA, 3215 bp, Homo sapiens
gacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 19035 - DNA, 3311 bp, Homo sapiens
gacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacaggtgcggctggctgggggtggctgcaggaaccgggctcagagaggcgtcccggacgccacaagcctcccggtgtcagcgccctgtcctcccctgcagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 19036 - DNA, 1779 bp, Homo sapiens
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggtaccgcccccgccaggcaggagactggcggtggaccaggtggagccgatgtaaacaggcattcttggttcgctctgtgaccccagatctccgtccaccgcccgtgcgcacctacggcttccttcctgcacgtcacctctgggactcgccgcggctccttacactctaa

SEQ ID NO: 19037 - DNA, 1950 bp, Homo sapiens
gaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttga

SEQ ID NO: 19038 - DNA, 1743 bp, Homo sapiens
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggtaccgcccccgccaggcaggagactggcggtggaccaggtggagccgaaggcctgtaaacaggcattcttggttcgctctgtgaccccagatctccgtccaccgcccgtgcgcacctacggcttcgccacttcctgcacgtcacctctgggactcgccgcggctccttacactctaa

SEQ ID NO: 19039 - DNA, 2817 bp, Homo sapiens
atgacactcctggggtctgagcattccttgctgattaggagcaagttcagatcagttttacagttaagacttcaacaaagaaggacccaggaacaactggctaaccaaggcataataccaccactgaaacgtccagctgaattccatgagcaaagaaaacatttggatagtgacaaggctaaaaattccctgaagcgcaaagccagaaacaggtgcaacagtgccgacttggttaatatgcacatactccaagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagatggctggtttacactcttctgataaggtggggccaaagttttcaattccatccccaactttttctaagtcaagttcagcaatttcagaggtaacacagcctccatcctatgaagatgccgtaaagcagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtag

SEQ ID NO: 19040 - DNA, 6821 bp, Homo sapiens
aatcgccggcagcctatgacatcagacaggaacgcctgggatgccgcgctgctcctggccaacctccgaggaggaggagggtcccgccggctaagagttaattagccccgcacggcgaggggggaggcgccagttttctggggacactggctgccactgtactcctacccaggggagctcacggagagttggatgaattctgggttgttagctgcggtcagctgggctcccgggagcctgttgctggtggagaacagggggcgcctggccaagggaccagcggcttgctgagactcaacatgacactcctggggtctgagcattccttgctgattaggagcaagttcagatcagttttacagttaagacttcaacaaagaaggacccaggaacaactggctaaccaaggcataataccaccactgaaacgtccagctgaattccatgagcaaagaaaacatttggatagtgacaaggctaaaaattccctgaagcgcaaagccagaaacaggtgcaacagtgccgacttggttaatatgcacatactccaagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagcttctctccccattcttccagcctccacccgcccttctctggagcccaagcagacagcagtcatggtgccgggggaaacccttgtcccaaaagcccatgtgtacagcaaaagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttctagcccataatttttctcaggcattgttggggcataagctcacactgtaagcttttctcatgaattcactagacataacgtggaaggaaaacgtagtcttttgggagtacagggaagccagcccctcaaagcttatggaagacatacctgcaatggaagctgttgcccaatgtctccattactatctttcaaaagagaagccagacccagcttcagatcaaaagttcttgagacagaggaacaaaaccaatcgatttccagggaagctaatcaactctcttttccctctaccacaaaactgccctgctggagtggttctgaacctgtacccaggactcgatgtggtcactaataacaattaacctgaactgagtccacagaactccactcggaactttcttcttttttaactagtggcccaatcattcccaccatctctgtgctgataagtacgtgtcctagatgagaaccctgaagaatgcagaccttcttcccccgaaggagatgccacaagctctccaacacagccccctttagttccaaagactagagatgaccacattggtagaagtatatctcgaggcacaggaagggagccccaccagggataattcagacaggactagagaataacatcatttcacataccctgggataaacaccctgggttcctatagaaggactattacttatgggagtccaacttctccttttgttttgttattatcagtttatctttctcccactccacttttccttcaaggtaccaatcctttcctgttcctcgtttggccatctttctttttctgcctccacattgggaggggaggacttctcagttctaacaagctgccatactcctaagaaagccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaagagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaaaaaaaaaaaaaagttgttcactgtgcacttatagaaaaaataatcaaaaatgttgggattttagaagctctctttttgataaaccaaagatttagaagtcattccattgttaacttgtaaaaatgtgtgaacacagagagtttttggtgattgctactctgaaagctgccagatcttattctgggggtgggatgtggaggaatacacatacacacacaaacatacatgtatgtataatagatatatacatatgtgtatattatatctgtgtgtgcatgtatctccaaaagcggcgttacagagttctacaccaaaagcctttaacccttaatctgctgtgaatgatacctggcctttctcactatgaatttctgattaaccaaccagactacacgttgcctctctgtgtatgactaacggctccaacccgatgactcacagctacttgcttatcgtgaacaagctcatcttggcaatgaatatggatgtgaaaagacagaacagcttcaccattagtagctggaaatggtatcacagtctcttatagaggaatatgaaaggaacaagaaaatcattttacattccttttatctgtattgtgctttaaaagatccacatggtaaattttttattttgcttttatgtcagtcatcagaaccaaaaaaatccagaagaaaaaattgccagtgtttcctttgaagatgaagctactggggaagaaaaccttattaatacactccacacatttgttcattcctcagctgttggtgttttcttggggtcttgacaaagcttgctggtcagtgcacttttcaggtgtcacgttttgctgtttgtatgttttttcttccccttacttcctttggaaaacaaactcacacagtgcccctactctgagacctgggactgagtgttaattattttttccttgggtatttctatctgagagactagacctagttaggaggcctctgtacttctccagattgtacctttttatggggatctttgaggctatgacccaggactgatagatatgccttacggaagacaaaagataaaatggttcctatatcctaatgcaaaccaacacagttaaaagagcagatctctggataactgctctcaacctgcttctacagtctccacaaaccgcattcaccctctctcttcatagctcagacatgaaatttgagggagaaaactggagataattgggagaaaattgatgaagttggctgcttccagtagatcagataatccatgaatttgtctcccattgagaattttattttaaattcttttaaactcttcgttgtgtcttttgtgatgacaaatcaggcatgactaaaagatgtacagagacttacgaagatggtcacattcaagttccctaatgctcttagaacctgaagatgaccatgtgtagttttcttaagacctctgaacccccatggtgatgaagacttgaagacatttgcagctatctgctgcagtctggtagattcatacttatctaaagaagtcaaaaaatttattcgtgcaagtgcttgcaggaagccagtgcttattagtagtgaccctgcttctatcaacgttattgagacaacacatattctattctaagggagaaagagggaggaagagagggagggagggaggaagaagagggagggagcgaggaaggaagataggagatgggtaggggggtaaagagaaaaggagggagaagggaaggaaggaaagaagagaggaaagaaaggagggaaggaaaaaagggccaaactttctgatctatgaacttctcagttcagctgtcacattatgagaagtaaatcagaatttttttaaggagaagtcattcttagcactacaataattgtaccagtaattgaggaaaccaagacaatcttcacctgaataatagagggtctgagaactgtcagccttttgccattcaaaaacatttatgtccaacctgaaaaaaaagcatcaataaaacctatcccaagcattc

SEQ ID NO: 19041 - DNA, 2344 bp, Homo sapiens
aaaatcgattgctctctgccacaaaccggagacccttcttgggcgatccgctttctcagcatgtggaaggtttttctctctctcttctttttctactaaaccttccgctcctaaacccattcctcgtgtgtatccctgtcctgaattctttctcgaccatgacaaagaaccagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagcttctctccccattcttccagcctccacccgcccttctctggagcccaagcagacagcagtcatggtgccgggggaaacccttgtcccaaaagcccatgtgtacagcaaaagatggctggtttacactcttctgataaggtggggccaaagttttcaattccatccccaactttttctaagtcaagttcagcaatttcagaggtaacacagcctccatcctatgaagatgccgtaaagcaggtaaccatgtgatttgttctttatggaagaatagactgactcaatgaacagacattgtttgatatgattaaacttcacgcagtttgtaaattc

SEQ ID NO: 19042 - DNA, 8466 bp, Homo sapiens
aattagccccgcacggcgaggggggaggcgccagttttctggggacactggctgccactgtactcctacccaggggagctcacggagagttggatgaattctgggttgttagctgcggtcagctgggctcccgggagcctgttgctggtggagaacagggggcgcctggccaagggaccagcggcttgctgagactcaacatgacactcctggggtctgagcattccttgctgattaggagcaagttcagatcagttttacagttaagacttcaacaaagaaggacccaggaacaactggctaaccaaggcataataccaccactgaaacgtccagctgaattccatgagcaaagaaaacatttggatagtgacaaggctaaaaattccctgaagcgcaaagccagaaacaggtgcaacagtgccgacttggttaatatgcacatactccaagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagcttctctccccattcttccagcctccacccgcccttctctggagcccaagcagacagcagtcatggtgccgggggaaacccttgtcccaaaagcccatgtgtacagcaaaagatggctggtttacactcttctgataaggtggggccaaagttttcaattccatccccaactttttctaagtcaagttcagcaatttcagaggtaacacagcctccatcctatgaagatgccgtaaagcagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttctagcccataatttttctcaggcattgttggggcataagctcacactgtaagcttttctcatgaattcactagacataacgtggaaggaaaacgtagtcttttgggagtacagggaagccagcccctcaaagcttatggaagacatacctgcaatggaagctgttgcccaatgtctccattactatctttcaaaagagaagccagacccagcttcagatcaaaagttcttgagacagaggaacaaaaccaatcgatttccagggaagctaatcaactctcttttccctctaccacaaaactgccctgctggagtggttctgaacctgtacccaggactcgatgtggtcactaataacaattaacctgaactgagtccacagaactccactcggaactttcttcttttttaactagtggcccaatcattcccaccatctctgtgctgataagtacgtgtcctagatgagaaccctgaagaatgcagaccttcttcccccgaaggagatgccacaagctctccaacacagccccctttagttccaaagactagagatgaccacattggtagaagtatatctcgaggcacaggaagggagccccaccagggataattcagacaggactagagaataacatcatttcacataccctgggataaacaccctgggttcctatagaaggactattacttatgggagtccaacttctccttttgttttgttattatcagtttatctttctcccactccacttttccttcaaggtaccaatcctttcctgttcctcgtttggccatctttctttttctgcctccacattgggaggggaggacttctcagttctaacaagctgccatactcctaagaaagccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaagagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaaaaaaaaaaaaaagttgttcactgtgcacttatagaaaaaataatcaaaaatgttgggattttagaagctctctttttgataaaccaaagatttagaagtcattccattgttaacttgtaaaaatgtgtgaacacagagagtttttggtgattgctactctgaaagctgccagatcttattctgggggtgggatgtggaggaatacacatacacacacaaacatacatgtatgtataatagatatatacatatgtgtatattatatctgtgtgtgcatgtatctccaaaagcggcgttacagagttctacaccaaaagcctttaacccttaatctgctgtgaatgatacctggcctttctcactatgaatttctgattaaccaaccagactacacgttgcctctctgtgtatgactaacggctccaacccgatgactcacagctacttgcttatcgtgaacaagctcatcttggcaatgaatatggatgtgaaaagacagaacagcttcaccattagtagctggaaatggtatcacagtctcttatagaggaatatgaaaggaacaagaaaatcattttacattccttttatctgtattgtgctttaaaagatccacatggtaaattttttattttgcttttatgtcagtcatcagaaccaaaaaaatccagaagaaaaaattgccagtgtttcctttgaagatgaagctactggggaagaaaaccttattaatacactccacacatttgttcattcctcagctgttggtgttttcttggggtcttgacaaagcttgctggtcagtgcacttttcaggtgtcacgttttgctgtttgtatgttttttcttccccttacttcctttggaaaacaaactcacacagtgcccctactctgagacctgggactgagtgttaattattttttccttgggtatttctatctgagagactagacctagttaggaggcctctgtacttctccagattgtacctttttatggggatctttgaggctatgacccaggactgatagatatgccttacggaagacaaaagataaaatggttcctatatcctaatgcaaaccaacacagttaaaagagcagatctctggataactgctctcaacctgcttctacagtctccacaaaccgcattcaccctctctcttcatagctcagacatgaaatttgagggagaaaactggagataattgggagaaaattgatgaagttggctgcttccagtagatcagataatccatgaatttgtctcccattgagaattttattttaaattcttttaaactcttcgttgtgtcttttgtgatgacaaatcaggcatgactaaaagatgtacagagacttacgaagatggtcacattcaagttccctaatgctcttagaacctgaagatgaccatgtgtagttttcttaagacctctgaacccccatggtgatgaagacttgaagacatttgcagctatctgctgcagtctggtagattcatacttatctaaagaagtcaaaaaatttattcgtgcaagtgcttgcaggaagccagtgcttattagtagtgaccctgcttctatcaacgttattgagacaacacatattctattctaagggagaaagagggaggaagagagggagggagggaggaagaagagggagggagcgaggaaggaagataggagatgggtaggggggtaaagagaaaaggagggagaagggaaggaaggaaagaagagaggaaagaaaggagggaaggaaaaaagggccaaactttctgatctatgaacttctcagttcagctgtcacattatgagaagtaaatcagaatttttttaaggagaagtcattcttagcactacaataattgtaccagtaattgaggaaaccaagacaatcttcacctgaataatagagggtctgagaactgtcagccttttgccattcaaaaacatttatgtccaacctgaaaaaaaagcatcaataaaacctatcccaagcattcaaaatagtcctttccaaatgttatttattttaaagtcaatcagctcttttagaaacagattctggtctggctgaaaactcccacaacaaatttactcatccagtggctaatatttaatgcccaccatgggcagagcacacaaatcttcagataaacaatactgaattgattcagcacagattgttcagatttgaatgaccagggagttgtatttgcacatgcaagaacactaagaatctcccagtcctcaaactagaaacctttcagctacgatgaaaaaaaaaaaggggtcttcatttttccaagagggggtggaggtggggatcactttttagctaaaagctatctctcacttcaaaattcttgtctttttctttgtggacaaacaccagtagtctatcacttggagatcttttaatatctcccatcatttaaaacatccacgagagtttgaagatttgtgttgattgccagatacagaagccccttgaaaataaggaaagggtggaggaagcatttttgtgtcctatccctacttatcgtagcagctctatagacaaaagggacacttactggtgagcctctggcccttaaaagaaaatcatctaagaatatgaaggcaatttgatttccccccacagccctcagctgccttcctcacagaaggaagttcccaaaattgctggtacacagtttgcaatcaaatatcagatatgagaaaacctgtagtgaagagtctgggttcttggttttctcataaatccaatataaatttgtaggttggttcagggtcaaaattgccagtgctttattagacagatgatactgatagacacacagagcccaggtcctggaacaagacaatcctgtagtgccaagatctggtcagttgcgttaaggagctgggtttgattctagagtccaggtttatagagaaaccctggctagattgagcctacccatggggagacgatttcaagacaggatgagatctgggaagaattttgttgtcatctgccagggaaattatcacaggactcattgaatgcaataacatgtgagtaagttcccttttgattctgggaatcagcgattttccctgtggattaagacaaaccaacgccagaaggtctcctgtgcttattttaaccatctgctcccatcgtgaaccctggagcatgcatttcctagaagtggtttcatagctcctgtgtgttcatggaaaaggggagtataatgatggggatgctggaagcttttttaatgttttccaaaggaaaggaacccacactgctccccagagttcctttccaatggccctgcagtaagaacggaggacaatgtattgctgggtgcttaaaatcctccctcagtgaagcacaaagagacactttgtaaagaaaaaaagagcaagcataggttctctgtgggaccttgtggagtggtgttttcacgttggtctctttggctcaattgagcataatcagaaagaaatgtgggttattgggaagagacaaaaagcagtggctaaaataccaaagttggcatgtgttcttttttaaaaaaaaaaaaaaatgcatatatttttaaataaaatgtttattttaaaaagaaa

SEQ ID NO: 19043 - DNA, 3632 bp, Homo sapiens
ttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagcttctctccccattcttccagcctccacccgcccttctctggagcccaagcagacagcagtcatggtgccgggggaaacccttgtcccaaaagcccatgtgtacagcaaaagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttctagcccataatttttctcaggcattgttggggcataagctcacactgtaagcttttctcatgaattcactagacataacgtggaaggaaaacgtagtcttttgggagtacagggaagccagcccctcaaagcttatggaagacatacctgcaatggaagctgttgcccaatgtctccattactatctttcaaaagagaagccagacccagcttcagatcaaaagttcttgagacagaggaacaaaaccaatcgatttccagggaagctaatcaactctcttttccctctaccacaaaactgccctgctggagtggttctgaacctgtacccaggactcgatgtggtcactaataacaattaacctgaactgagtccacagaactccactcggaactttcttcttttttaactagtggcccaatcattcccaccatctctgtgctgataagtacgtgtcctagatgagaaccctgaagaatgcagaccttcttcccccgaaggagatgccacaagctctccaacacagccccctttagttccaaagactagagatgaccacattggtagaagtatatctcgaggcacaggaagggagccccaccagggataattcagacaggactagagaataacatcatttcacataccctgggataaacaccctgggttcctatagaaggactattacttatgggagtccaacttctccttttgttttgttattatcagtttatctttctcccactccacttttccttcaaggtaccaatcctttcctgttcctcgtttggccatctttctttttctgcctccacattgggaggggaggacttctcagttctaacaagctgccatactcctaagaaagccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaagagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaaaaaaaaaaaaaa

SEQ ID NO: 19044 - DNA, 2083 bp, Homo sapiens
catccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaa

SEQ ID NO: 19045 - DNA, 1986 bp, Homo sapiens
atatataaacctctctggagctcgggcatgagccagcaaggccacccatccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttaccc

SEQ ID NO: 19046 - DNA, 2081 bp, Homo sapiens
catccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttaccc

SEQ ID NO: 19047 - DNA, 2042 bp, Homo sapiens
gaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttcagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttaccc

SEQ ID NO: 19048 - DNA, 5491 bp, Homo sapiens
agaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacgatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatatttgaagagacaactaaatacgaacaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgct

SEQ ID NO: 19049 - DNA, 5824 bp, Homo sapiens
atagtccgcccccacgtccttgtggaatagcgcccgcttccaagcaccgtgactctctttgccctacccttgtctttcccattccaattactctagaacccaccgagaggataattcagtcctgaaaagaaactgatggggagaagcgaggaagggaacccaggagggaggggaggcagggctgcggagggacaccgaggcggcggaggtagtgcgcacgcgcagcacagaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgctaaaggttgttgtaaactgtttgtctcccgcactcactccagtaa

SEQ ID NO: 19050 - DNA, 5182 bp, Homo sapiens
gcgcggatgtcccggcgagtcccgggctgaaagaggcggctccgggcggcgcgaagcgctggtggcgggcccgggctgcggcgtgtgcgcgcccgccagctgctccggagatacgatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaa

SEQ ID NO: 19051 - DNA, 5365 bp, Homo sapiens
gccatgagtgccttggcaaggctttaaatactttgagggctctcaccagaggcctaattgctaccctttggagctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgct

SEQ ID NO: 19052 - DNA, 2854 bp, Homo sapiens
ggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaac

SEQ ID NO: 19053 - DNA, 5413 bp, Homo sapiens
agctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgctaa

SEQ ID NO: 19054 - DNA, 565 bp, Homo sapiens
cgtgcgcggatgtcccggcgagtcccgggctgaaagaggcggctccgggcggcgcgaagcgctggtggcgggcccgggctgcggcgtgtgcgcgcccgccagctgctccggagatacggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctct

SEQ ID NO: 19055 - DNA, 2186 bp, Homo sapiens
agaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacgatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatatt

SEQ ID NO: 19056 - DNA, 574 bp, Homo sapiens
agtcgcgcgggctggtggcgagcagcctccccgggcgcgcaccccttggggccggggggcggtggtggacgtcgcctccttgaaagttgaaggagttctcgggagaccccggagaaggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaag

SEQ ID NO: 19057 - DNA, 732 bp, Homo sapiens
gatttgccacgcgccgcgtcaccgggccgctcccggcctgggctcccgggggctggtcagggaggtggcggcggctgagcggcggagcgggggcggcagggcgcgacgccgccgggccgccccgccctgggaggcgcccgggccctcatcaagtgaccagtatcccttccaggggaacacggtccttcagaggaaagcgagctccaacccgcggccccggcgccaagccgccgtcatcttcttcctgtgccaggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgtt

SEQ ID NO: 19058 - DNA, 1623 bp, Homo sapiens
gcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacgg

SEQ ID NO: 19059 - DNA, 1683 bp, Homo sapiens
atcttcgtgcagccgccgcgggtccgtgcgcccagcgtcccagggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgaggtaccccagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccaggtaagtgccctgagacgacggcaagtcccagtcctccaaagccccggccgctgctgacccctggtggccatccctggtactgcgcacacttccggtacggatgggcagctattttgaggccccaagagggaccgccaccccctcctttcccagggtcctcctgccaagcctttgcccacgctgtgccatcccctggcttccttcccttcctcgctgagctcacggcctccctctctctttccccctgcagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccag

SEQ ID NO: 19060 - DNA, 1405 bp, Homo sapiens
cgggtccgtgcgcccagcgtcccagggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggacca

SEQ ID NO: 19061 - DNA, 1949 bp, Homo sapiens
gtacgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggacc

SEQ ID NO: 19062 - DNA, 6203 bp, Homo sapiens
aagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgatgcagtgtccgtggtgcat

SEQ ID NO: 19063 - DNA, 4095 bp, Homo sapiens
cgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatatt

SEQ ID NO: 19064 - DNA, 721 bp, Homo sapiens
aagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcc

SEQ ID NO: 19065 - DNA, 609 bp, Homo sapiens
gaagctgcttcctcggtaaatatttccaaactgattagaaagttcatggccccgcgatgaagtcgagatctcaaatactgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagc

SEQ ID NO: 19066 - DNA, 773 bp, Homo sapiens
cacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatacttcttaggaaaggcagcattttacttcattcattaattgcaccatttacgtcctgattgctgtgcatgtggaatatattgaaagataatattaaagtgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgt

SEQ ID NO: 19067 - DNA, 6458 bp, Homo sapiens
gcgatgtttcaaacgctgtgagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtggtaatacaaaactacattttaaagaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 19068 - DNA, 854 bp, Homo sapiens
atgaattagctgccctacttagcatacacagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacct

SEQ ID NO: 19069 - DNA, 623 bp, Homo sapiens
ctttagcatctgtccagaagaaattcttctcgacttgggtctcaaaccactttgccttcatctgcctgcttatgccaaactcaaaatgagcagaagcctgccataatgaagttcccctttttagaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaag

SEQ ID NO: 19070 - DNA, 557 bp, Homo sapiens
acatttcttcccttggagaattgaagcaaatatgcagtacgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatcta

SEQ ID NO: 19071 - DNA, 573 bp, Homo sapiens
aatttttcataacgggtgaaattgtcacctaatttcattaaaaagattaggaaactttttacaaaaaaaaatacatttcaagtgttagtctttaaaaaagcatagtttgcatcatttaaatgacttgttaaattacttatgagatcattttaattgttaaaaaataaaactacttgatctgctcctgtctgtgatataccatatatttttaacaaaaaagttatttttattcattttattgctttagctccatatagtttatttccttgataaaattagaatatgatagttcttatgaaactgacttgctgttagagtggtatttaatttttcttttttgttcagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgat

SEQ ID NO: 19072 - DNA, 3537 bp, Homo sapiens
acttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaa

SEQ ID NO: 19073 - DNA, 1061 bp, Homo sapiens
catcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatg

SEQ ID NO: 19074 - DNA, 1747 bp, Homo sapiens
acacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattat

SEQ ID NO: 19075 - DNA, 4079 bp, Homo sapiens
atcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatatt

SEQ ID NO: 19076 - DNA, 1254 bp, Homo sapiens
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatga

SEQ ID NO: 19077 - DNA, 6304 bp, Homo sapiens
atagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgatgcagtgtccgtggtgcatttttttaaattaatgttttgctgtttaaatttattcaattttattgtgttttttaaaaagcagc

SEQ ID NO: 19078 - DNA, 5868 bp, Homo sapiens
atatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgaggcgctgcacaagaagcacagggaatgtgagagccctgaggtggacgaggtgtttgccctgaccccccagacggaagagaaatataaaaagatagacgaggagtttgataaaatgatgcagagttatagactggcctcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctg

SEQ ID NO: 19079 - DNA, 5965 bp, Homo sapiens
ctcaagctaggctgagctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgata

SEQ ID NO: 19080 - DNA, 5733 bp, Homo sapiens
atatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctg

SEQ ID NO: 19081 - DNA, 3194 bp, Homo sapiens
ggggcctgagaccacccctgccctaggcccagctttcctggactgcctgcccccacaaaccaacagcccgcccccaggtccccagtcgaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacga

SEQ ID NO: 19082 - DNA, 5850 bp, Homo sapiens
atatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctg

SEQ ID NO: 19083 - DNA, 1668 bp, Homo sapiens
gaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgaggcgctgcacaagaagcacagggaatgtgagagccctgaggtggacgaggtgtttgccctgaccccccagacggaagagaaatataaaaagatagacgaggagtttgataaaatgatgcagagttatagactggcctcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctgg

SEQ ID NO: 19084 - DNA, 1905 bp, Homo sapiens
ggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatggggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgt

SEQ ID NO: 19085 - DNA, 1629 bp, Homo sapiens
ggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaga

SEQ ID NO: 19086 - DNA, 1622 bp, Homo sapiens
ctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccgtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtcca

SEQ ID NO: 19087 - DNA, 1183 bp, Homo sapiens
tccagagctcccggacagcagccggatcccggccggctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccaaacttttgcagagtttggacaggcaaaggaaaacgtgcagcccgcggatctccgggcctcagagagcagggagtcggggagactgaggccccgctccgagagcgcggaggaagcgcgcccagccggcttcctgtgggggctcgggcctcgggcgccccgcggacagacgtgtccggctcctggctgggccaagcccggcgcgggggaggggacccgcagaggggcgactgagaaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggact

SEQ ID NO: 19088 - DNA, 703 bp, Homo sapiens
agacggtgaggattgccttcggaggtgggtgaggcccagcgtgcgcgcccaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacc

SEQ ID NO: 19089 - DNA, 353 bp, Homo sapiens
ggagcgaggggggctggagggagagaaggaagaaggaaggggcgaacggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcacccca

SEQ ID NO: 19090 - DNA, 635 bp, Homo sapiens
ccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccgg

SEQ ID NO: 19091 - DNA, 1449 bp, Homo sapiens
gagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctaggcgagagcctggggtggggcgggagggggaacagtatggaaaagactggaaggggaaaggaagggaagggagggagggtctgttctatctgttgctgtaaataaagatatttgtccatctc

SEQ ID NO: 19092 - DNA, 1542 bp, Homo sapiens
acccaggccaacaggcgtctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatgaactaattttctggtctatatgacttcttccaggagggcctaatacacaggaagaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaagaaata

SEQ ID NO: 19093 - DNA, 1465 bp, Homo sapiens
agttttctttcaaactagatgttctagagagcactagctgcaatcacattgggagactgatgctccatgacagctaaaagttggattgagtttcaggagctactatatataaagctgggtcgacttatgtcactgcactaattaaatgccatctgggtggttcctctgggtttttgagtccatcacccagttcagatcgagtcagaggccaaggaggagaacatgatgatggacctttttgaaactggctcctatttcttctacttggatggggaaaatgttactctgcagccattagaagtggcagaaggctctcctttgtatccagggagtgatggtaccttgtccccctgccaggaccaaatgcccccggaagcggggagcgacagcagcggagaggaacatgtcctggcgcccccgggcctgcagcctccacactgccccggccagtgtctgatctgggcttgcaagacctgcaagagaaaatctgcccccactgaccggcgaaaagccgccaccctgcgcgaaaggaggaggctaaagaaaatcaacgaggccttcgaggcactgaagcggcgaactgtggccaaccccaaccagaggctgcccaaggtggagattctgcggagcgccatcagctatattgagcggctgcaggacctgctgcaccggctggatcagcaggagaagatgcaggagctgggggtggaccccttcagctacagacccaaacaagaaaatcttgagggtgcggatttcctgcgcacctgcagctcccagtggccaagtgtttccgatcattccagggggctcgtgataacggctaaggaaggaggagcaagtattgattcgtcagcctcgagtagccttcgatgcctttcttccatcgtggacagtatttcctcggaggaacgcaaactcccctgcgtggaggaagtggtggagaagtaactgagcctgcgcttgagaccttctccacgcagcaggaagatcccaccgacccttcctggcctaatcctttagattaggtcacattacattaacatttaggaacccagaccgaaaagttgctgaaagggaaggagacacattcacaaagaaacgttgcgaaaattgcgaaatctgttgtgcatgctcaaatgaaaacgcctttcggctttgggcttttatttttttggaactgcgagtggcttaggtctagcctcattttgtttttgtttggttggttttatactatattaacttttattacggtgatccttttgtgccatgttcaaaagaagttcattcctgtctaaagtgggaaagttgcatttaatgttaggggtatttaatgtatttttgtaaatagtttaacactttctttttttacgtaaacctgaaatatattttaaatgtggaatgatgtatataaaatgtgcgaggatcctggtattgtaatattaaaaagaagtttctatatgaa

SEQ ID NO: 19094 - DNA, 1528 bp, Homo sapiens
atggcacccagcagttggcgtgaggggctgctggagcttgggggctggtggcaggaacaagccttttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttgcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatcccctttccagggaggtaaagcaggggaccagagcgccccctcgtgtatgccccagctcagggggcaaactcaggagcttcctttttatcataacgcggcctctaattccaccccccaagtgaaacggtttgagagacgcagtgccctgacctggacaagctgtgcacgtctcctgttctggtctcttcccgatgccagtggctgggctgggcctgccctgaattgagagagaagaaggggagaggaacagccctctgttcccaagtccctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcattgtgtggttttgccattgttttgtattttttttttttttttttttttttgctaacttatttggatttccttttttaaaaaatgaataaagactggttgcca

SEQ ID NO: 19095 - DNA, 1170 bp, Homo sapiens
gagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctca

SEQ ID NO: 19096 - DNA, 1197 bp, Homo sapiens
gattagaccctccctggatgagagagagaaagtgaaggagggcaggggagggggacagcgagccattgagcgatctttgtcaagcatcccagaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctca

SEQ ID NO: 19097 - DNA, 1153 bp, Homo sapiens
aatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctca

SEQ ID NO: 19098 - DNA, 582 bp, Homo sapiens
gctataagacacctctccccacccccagccctggccgcttggctggaggctctgcgaggacagctggggagaaggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccaccc

SEQ ID NO: 19099 - DNA, 418 bp, Homo sapiens
cttggctggaggctctgcgaggacagctggggagaaggggagctgtgcccagatttaccaaagggaattgtcagctgtccaagggctagcaaattcctaggtcacctagattggattttctgaccataaaaactgtgggccaggtgcacagctgcctgaggggctcaaacctgtgcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatcctta

SEQ ID NO: 19100 - DNA, 648 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatg

SEQ ID NO: 19101 - DNA, 515 bp, Homo sapiens
gagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 19102 - DNA, 551 bp, Homo sapiens
agtgcccaacctcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 19103 - DNA, 1030 bp, Homo sapiens
aaaccccagctgttggggccaggacacccagtgagcccatacttgctctttttgtcttcttcagactgcgccatggggctcagcgacggggaatggcagttggtgctgaacgtctgggggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaac

SEQ ID NO: 19104 - DNA, 5014 bp, Homo sapiens
aacgggagggaggcacaggcgcttgctttgcaggagtcagctctgccttcctcggctggagtgtgggtggcttggtgagccggtggtcaggaattctctctcctccttgcaattttcctttctgtctgggagcacgccaagatgtcccttgtgactgtccccttctaccagaagagacataggcacttcgaccagtcctaccgtaatattcaaacacggtacctgctggacgaatatgcgtcaaaaaagcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtaccagtccctggtggccgcctatggtgaggccaagcgacagcgcttcctcagcgagctggcccacttggaggaggatgtccacctggcacgctcccaggcccgcgacaagctggacaaatacgccattcagcagatgatggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtggtacaaagatggcagtctgatttgccaggcggctgaaccgggaaagtacaggattgagagcaactatggcgtacacacactggagatcaacagggcagactttgacgacactgcgacatactcagcagtggccaccaatgcccacggacaagtgtccaccaacgcggcggtggtggtgagaaggttccggggagacgaggaaccattccgttcggtgggactcccgattggattgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatgacgtgctgttgaaagagtccaagtggacgaagatgttctttggagaaggccaggcctccctgtccttcagccacctgcacaaggacgacgagggcctgtacaccctgcgcatcgtgtctcggggcggcgtcagcgaccacagcgccttcctgtttgtcagagatgctgacccgctggtcacaggggcccccggtgcacccatggacttgcagtgccacgacgccaaccgggactacgtcatcgtgacctggaagccgcccaacaccaccactgagagccccgtcatgggctattttgtggaccgatgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaagccgttcatttggagggagagaaggagattgccatttatcaggatgaccttgaaggtgacgcccaggttccagggcctcccaccggtgtgcacgcttccgagatcagcagaaactatgtcgtcctcagctgggagccacccactccccgtggcaaggacccgctcatgtacttcattgagaagtcggtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccattggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtaaatcagacgacaacagccaaccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaatcgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 19105 - DNA, 3644 bp, Homo sapiens
gtcacaccgacctgcaccatctctcgcctgcctgtggggtttctgtcaactagtcgtggagggaaggagactctttaaagaataacatcttattgtggccatgccagaacccactaagaaagaggatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttg

SEQ ID NO: 19106 - DNA, 3861 bp, Homo sapiens
ttgtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctc

SEQ ID NO: 19107 - DNA, 3512 bp, Homo sapiens
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaagg

SEQ ID NO: 19108 - DNA, 3834 bp, Homo sapiens
agatgtgagaaaggtccccatagctgtcaagttcctgcatccttgtgctgaagaaagggaggtgccatcatgattgatgttcagaggcagtataaaagcactgggtttctccccaactgcttgtcacaccgacctgcaccatctctcgcctgcctgtggggtttctgtcaactagtcgtggagggaaggagactctttaaagaataacatcttattgtggccatgccagaacccactaagaaagaggactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagag

SEQ ID NO: 19109 - DNA, 3749 bp, Homo sapiens
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagaga

SEQ ID NO: 19110 - DNA, 4214 bp, Homo sapiens
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagcagcagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcaggtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactca

SEQ ID NO: 19111 - DNA, 4217 bp, Homo sapiens
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagcagcagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactca

SEQ ID NO: 19112 - DNA, 4217 bp, Homo sapiens
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactca

SEQ ID NO: 19113 - DNA, 3598 bp, Homo sapiens
ggcctagcgggacgcggctgcggtcagaggagcaggaggaggtcccccgacatgcctgaggcaaaaccagcggccaaaaaggcccccaaaggcaaagatgcccccaaaggagcccccaaggaggctccccctaaggaggctcctgcagaggcccccaaagaagccccacccgaggaccagtccccgactgcagaggagcccaccggcgttttcctgaagaagccggactccgtctcagtggagactgggaaggacgcagtggtcgtggccaaggtgaacgggaaggagctcccagacaaaccgaccatcaagtggttcaaggggaagtggctggagctgggcagcaagagtggcgcccgcttctccttcaaggagtcccacaactccgccagcaatgtgtacaccgtggagctgcacattgggaaggtggtactgggggaccgtgggtattaccgcctcgaggtcaaagccaaggacacctgtgacagctgtggcttcaacatcgatgtggaggcaccccgtcaggatgcctctgggcagagtctagaaagcttcaagcgtacgagtgaaaagaagtcggatactgcaggtgagctggatttcagtggcctgttgaagaagagggaggtggtggaggaggagaagaagaagaaaaagaaagatgacgatgacctaggcatccccccggagatttgggagctcctgaaaggggcaaagaagagcgagtacgagaaaatcgccttccagtatggcatcaccgacctccggggcatgctgaagcggctgaaaaaggctaaggtcgaggtcaagaagagtgcagcattcacaaagaagctggatccagcctaccaagtggacagaggcaacaagatcaagttgatggtagagatcagcgacccagacctgaccctcaagtggttcaagaacggccaggagatcaaaccaagcagcaagtacgtgtttgagaacgttggtaagaagcgaattcttaccatcaacaagtgcacgctggcggatgacgctgcctatgaagtagctgtcaaggatgagaagtgtttcaccgagctcttcgtcaaagaacctccagtcctaattgtcacacctcttgaggaccagcaggtgtttgtgggtgaccgggtggaaatggcagtggaggtgtcagaagagggtgcccaggtgatgtggatgaaagatggtgtggaactgactcgggaggattccttcaaggcccggtaccgcttcaagaaggacgggaagcgccacatcctcatcttctcagacgtggtccaggaggacaggggtcgctatcaggtcataaccaatggcggccagtgtgaggccgagctgattgtggaagagaaacagctggaggtcctgcaggacatcgcggatctgacggtgaaggcctcagaacaagctgtgttcaagtgcgaggtgtctgatgagaaagtgacgggcaagtggtataagaatggggtcgaggtgcggcccagcaagaggatcaccatttcccatgtaggcaggttccacaagctggtgatcgatgacgtccgccccgaggatgagggagactacacgtttgtgcctgacggctacgccctgtcgctctcggccaagctcaacttcctggaaatcaaggtggagtacgttcccaagcaagagccaccaaagatccacttggattgctcggggaagacctcagagaatgcgattgtggttgtggctggaaacaagctgaggcttgacgtgtccatcacaggggagccccctcccgtcgctacctggctgaagggagatgaggtattcacgaccaccgagggcaggacccgcatcgagaagcgggtggactgcagcagctttgtgattgagagtgcgcagcgggaagacgagggccgctacaccatcaaggtcaccaaccccgtcggcgaggacgtggcttccatcttcctgcaagttgtagatgtcccagaccccccggaggctgtgcgcatcacctcggttggagaggattgggccatccttgtctgggagccaccaatgtacgatggggggaagccagtcaccgggtacctcgtagagcggaagaagaagggctctcagcgctggatgaagctgaactttgaggtcttcacagagaccacctatgagtccaccaagatgatcgagggcatcctctatgagatgcgtgtcttcgccgtcaatgctataggggtctcccagcccagcatgaacaccaagccttttatgcctattgcacccacgagtgaacccctgcacctgatagtggaggatgtgacagacaccaccaccacactcaagtggaggcctccgaacaggatcggggcaggtggcatcgatgggtacctggtggagtactgcctggaaggctccgaggaatgggtccctgccaacaccgagcccgtggagcgctgtggcttcaccgtcaagaatctcccgaccggagccagaatcctcttccgagtagttggggtcaacatcgcggggcgcagcgagccggccaccctggcccagccggtcaccatcagggagattgcggagccacccaagatccggcttccccgccatctccgccagacctacatccgcaaagtgggcgagcagctcaaccttgtcgtccccttccagggaaagccccggccccaggtggtgtggaccaagggcggggccccgctggacacctcccgcgtgcacgtgcggaccagcgacttcgacaccgtgttcttcgtgcgccaggcggcccgctccgactccggggagtacgagctgagcgtgcagatcgagaacatgaaggacaccgccaccatccgcatccgcgttgtggaaaaggctgggccccccataaacgtgatggtgaaggaggtgtggggcacgaacgcgctggtggagtggcaggcccccaaagatgatgggaacagtgagatcatggggtatttcgtccagaaagcagacaaaaaaaccatggagtggttcaacgtctatgaacgtaacaggcacactagctgtactgtgtccgaccttatcgtgggcaatgaatactatttccgagtttacaccgagaacatctgtgggctcagtgactcacctggtgtctccaagaacacggcccgcatcctcaagacaggaatcaccttcaaaccgttcgagtataaggagcatgacttccggatggctcccaagttcctgacacctctcatagaccgcgtggtcgtggctgggtactcggcagccctcaactgtgctgtcagaggccacccgaagccgaaggtggtctggatgaagaacaagatggaaatccgtgaagatcccaagttcctgataaccaattaccaaggagtcctgacgctgaacatccgtcgcccctcgcccttcgacgctgggacttacacctgccgggccgtcaacgagctgggcgaggcgctggctgagtgcaagctggaggtccgagtgccgcagtgagacctgtcccctacctgccaagacaattggtggtggagtcctgaccccaatccccaacctcccaggactgtgttctttctggagttttcgctgagaacaaaacagtgttgtctggaccctg

SEQ ID NO: 19114 - DNA, 3856 bp, Homo sapiens
ttgtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtca

SEQ ID NO: 19115 - DNA, 3899 bp, Homo sapiens
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctca

SEQ ID NO: 19116 - DNA, 3871 bp, Homo sapiens
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaa

SEQ ID NO: 19117 - DNA, 3915 bp, Homo sapiens
ttgtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtca

SEQ ID NO: 19118 - DNA, 3818 bp, Homo sapiens
tcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaatt

SEQ ID NO: 19119 - DNA, 3426 bp, Homo sapiens
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataa

SEQ ID NO: 19120 - DNA, 3777 bp, Homo sapiens
gcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctca

SEQ ID NO: 19121 - DNA, 1805 bp, Homo sapiens
aggccccccaacggctgacccctgcacactccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcaggcccctgccccacaggcccctacagcctccacagccactaagcctgcacccccaagtgaagatgtccccagtgccccactgctgctgaccctggatgatgtgagcagcagctctgtgactgtgagctgggagcccccagagaggctggggaggctgggcctccagggctatgtgctggagctctgcagagagggagcctcggagtgggtgcctgtgagtgcccggcccatgatggtgacccagcagactgtgcggaacctggctctgggagacaagttcctcctgcgcgtgtctgcagtgagttctgcaggggctggcccgccggccatgctggaccagcccatccacatccgagagaacattgaggcccccaagatccgtgtcccccgccacctccgtcagacctacatccgccaggtgggagagacggtcaacctgcaaatccccttccaggggaagcctaagcctcaggccacatggacccacaacggccatgccctggacagccagcgggtgagcatgcgcaccggggaccaggactccatcctcttcattcgctcggcccagcgctccgactctggccgctacgagctcactgtgcgcgtggaagacctggaggccaaggcagtcattgacatcctggtgattgagaaacctggaccccccagcagcatcaggctcctggacgtctggggctgcaatgctgctcttcagtggacgccaccccaggacacaggcaacacagagctcctgggctacatggtgcagaaggcagacaaaaagacagggcaatggttcacagtgctggagcgctaccacccaaccacctgcaccatctctgacctcatcatcggcaactcgtactccttccgggtcttctcagaaaacctgtgtggactcagcacctcggccaccgtcaccaaggagctcgcccacatccagaaggcagatattgctgccaaacctaaagggtttattgagcgagacttctcagaagccccctcattcacccagcccctggctgaccacacctccacccctggctacagcacccagttgttctgcagtgtccgagcttcacccaagcccaagatcatctggatgaaaaacaagatggagatccagggcaaccccaaataccgcgccctctctgagcaaggcgtctgcaccctagagatccggaaacccagcccctttgattctggggtctacacctgcaaggccataaatgtgctgggggaggcatctgtggactgccggctggaggtcaaagcctcagccgcacactgaagtcacgggaggaggctgtgatgaggagccaggtgctgcaggcctgaggggccaggtccaccaggcctacagtcaaactccagagatgcccaagacccccgcttccatagcgacggctgatggaaccgcccctggtacctgctggcctcccttccccagaggctggtgtccagaactcaggaatgggcctggtaggccccaggccagactaactgggctcaaggggtgctggaaggcgcagagattggagtgccctgcggagttgcactctgggtgggaagcactcaaataaagatgcgtggtgttaacagtg

SEQ ID NO: 19122 - DNA, 6222 bp, Homo sapiens
aaattgctgtgaccgcagcatctctaggaagacgctttattcctgaaggacactgactgtcacttgggaaccaagaagccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccggatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactgatcgagacaaccagtctatcctcatcaccggagaatccggggctgggaagactgtgaacaccaagcgtgtcatccagtattttgcaacaattgcagttaccggggacaagaagaaggagacacagccaggcaaaatgcagggaaccctagaggatcagatcatccaggccaacccactgctggaggcctttggaaatgccaagactgtgaggaatgacaactcctcaagatttgggaagttcattcggattcattttggagccacaggaaagctggcatcggcagacatcgaaacttatctgttagaaaaatccagagtgacgtttcaattatccagtgagagaagctatcatattttctaccaaattatgtcaaacaagaagccagaactaattgacctgcttctgatctccaccaaccccttcgacttccccttcgtgagccaaggagaggtcacggtagccagtatcgatgacagtgaagaactgctggcgacagataatgccattgacatcctgggcttcagctcagaggagaaagtcgggatctacaaactgacgggagccgtgatgcattatgggaacatgaagttcaagcagaagcagcgtgaggagcaggcggagccagacggcaccgaagtggctgacaaagccggatacctgatgggactgaattctgcagaaatgctgaagggcctgtgctgtccaagggtgaaggttggcaatgaatatgtcactaaagggcaaaatgtccagcaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaacgagactgtggtggggctgtaccagaagtcttcgctgaagcttctctccttccttttttccaactatgctggtgcagagacaggcgactccggaggaagcaagaagggcgggaagaagaagggctcctctttccagaccgtgtcggccgtgttcagggaaaatttaaacaaattgatgactaacttaaggagcacccaccctcactttgtacgatgtctgattcccaatgagaccaagactcctggtgtgatggaccactacttggtcatgcaccagctgcgctgtaacggggtcctcgagggcatccggatttgcaggaagggattccccagccggatcctctatgctgacttcaagcagcggtaccggatcctcaatgccagtgctatccctgaagggcagttcattgacagcaaaaatgcctcagagaagctcctcaactccatcgatgtggaccgggagcagttcaggttcggcaacaccaaggtgtttttcaaagctgggctcctgggacttttggaggagatgagagatgagaagctggtgacgctgatgacaagcacgcaggcggtgtgcagggggtacctgatgcgggtggagttcaagaagatgatggagaggagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatcttgagggttccttagagcaggagaagaaactgcgggcggacttggaaagggcgaagaggaagctggaaggagatctgaaaatgtcccaggaatccattatggatctagaaaatgacaagcagcaaatagaagagaaattgaaaaagaaggagtttgaactcagtcagttacaagccaaaatagatgacgaacaagtccacagtttgcagtttcaaaagaagattaaagaactgcaagcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagattgacgacatggccagcaacatcgaggctctctccaagtcaaagagtaacatagaaagaacgtgccggacggtagaagatcaatttagtgaaatcaaagccaaggacgagcaacagacacagttgatccatgatctgaacatgcagaaagcaagactgcagacccaaaatggggagctgagccaccgagtggaagagaaggagtctctgatttcacagctgaccaaaagcaagcaggccctcacccagcagctggaggagcttaagaggcaaatggaagaagaaaccaaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaggaccaaatacgagacggacgccattcagcgcacagaggagctggaggaggccaagaaaaaactggcccagaggctccaggaagcagaggagaacacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttgcagagtggaagcaaaagctggacgaaagccaggctgagttggaagctgctcagaaggagtccaggtcactcagcactgaactcttcaagatgaggaatgcctatgaggaggtggtggaccagttagagacactgaggcgagagaacaaaaatctgcaagaagagatttccgacttaactgagcagattgcagaaactggcaagaatcttcaggaagcggaaaagaccaagaagctagtggagcaggaaaagtcagatctgcaggtcgccttagaagaagtggagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaagcatctgcgcacggtccagggccagctcaaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccagaacacaagcctgataaataccaagaaaaaactggaggctgacatagctcagtgccaggcagaggtggagaactcgatccaggagtccaggaacgcagaggagaaggccaagaaggccatcacggatgctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtgcgggagctggaaaatgagcttgatgtggaacagaagaggggagctgaagccctgaagggagcccacaagtacgaacgcaaagtcaaggagatgacttaccaggctgaggaggaccacaagaatatccttaggctccaggacctggtggacaagctgcaggccaaagtgaagtcttacaagaggcaggctgaggaggcggaggagcaggccaacacgcagctgtccagatgccggagagtccagcatgagctagaggaggccgcggagagggcggacatcgctgagtcccaggtcaacaagctgagggccaagagccgagacgtgggcagccagaagatggaagaatgaggctcacctgatgctcgttgccatgggacacctccgagagagtggagggaaaatgtgtgagaaataaattctcctaaatactcggattcccggctctgctgtgtttattatcatggtccattcctcttctatgaagctgatatttagattcttgctgctctatcgtaaatataaaataaggaatgtgaaagtggaggatctttgctccaagtagaaaacatggaaatccaacccatggccagattctccttttcatctcatcaccagcccaccccaaatgcctttgacacagtggggttggaaattgaggaggat

SEQ ID NO: 19123 - DNA, 6896 bp, Homo sapiens
gaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgaacatgggggcttccagcagttctctttccttggctccttcccaccgtcgcccccaggatctgcagagaggtgcagctctgctatttctccgccaggggtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaccatc

SEQ ID NO: 19124 - DNA, 6037 bp, Homo sapiens
gtggctcgcttgtgggcggaggtctgggatctcctggctgttgctgtcttctgctctcatcctgcaggtgggactctcagctgacaccatgagtagtgacactgaaatggaagtgttcggcatagctgctcctttcctccggaagtcagaaaaggagaggatcgaggctcagaaccagccctttgatgccaagacgtattgcttcgtggtggactcaaaggaagaatatgccaaggggaaaatcaagagttctcaggatgggaaggtcactgtggaaactgaggacaacaggaccctggtggtcaaaccagaggatgtgtacgccatgaacccccccaagttcgacaggatcgaagacatggccatgctgacgcacctgaatgagccagccgtgctgtacaacctgaaggaccgttacacatcttggatgatctatacctactcaggcctcttctgtgtcactgtcaacccctacaagtggctgccggtgtacaaccccgaggtggtggaaggctaccgaggcaaaaagcgccaggaggccccaccccacatcttctccatctctgacaacgcctatcagttcatgctgactgatcgtgaaaaccagtccattctgatcaccggagaatccggggcaggaaagactgtgaacaccaaacgggtcatccagtactttgcaacaattgcagctactggggacctggccaagaagaaggactccaaaatgaaggggactctggaagatcaaatcatcagtgccaatcccctgctggaggcctttgggaacgccaagactgtgaggaatgacaactcctcccgttttggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatgcagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggccgaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggcgattttaaacaaagataccgagtgctgaatgccagtgcaatccctgagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcagagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacagagaacaaggttaaaaaccttactgaggaactctctgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgagtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcggagttcctgaagctgcgcagggacctggaggaggccacactgcagcacgaagccatggtggccgcgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagatcgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccggggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaatctgg

SEQ ID NO: 19125 - DNA, 3621 bp, Homo sapiens
gactggcacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggttca

SEQ ID NO: 19126 - DNA, 560 bp, Homo sapiens
gctgagagttggagaatcaagtctctcttcaggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgta

SEQ ID NO: 19127 - DNA, 3658 bp, Homo sapiens
aatgcaagggggagttcaatgaaactgggacatctatacacatgtgagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggttca

SEQ ID NO: 19128 - DNA, 3101 bp, Homo sapiens
agtctgctccaagtagagagagtggatgaacctgcgtgctggagattgagtgaaagatggtgtcttgaactggtttcacaatagtcattgcccacttcctccccacaagctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagagg

SEQ ID NO: 19129 - DNA, 4933 bp, Homo sapiens
gccccgcagccccgggctgggcccgcgtcccggagcgccaccggagagcgaggacgacgtggaggcggagtggcgcccggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggcacgaagggaactgagacggctgaaggaggaggctaggaataaacatgctattgcagttatttgggcttactggcttggatctaaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 19130 - DNA, 5026 bp, Homo sapiens
ggtggctcccgttcctgcccgcgcgccgaggggcgaatcccaggcagcgaggtcgccgcccccgcccctcggccggcccctccgccagcgggcgagaggggagtggccgggctcctcccgccgccgctgagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 19131 - DNA, 4764 bp, Homo sapiens
agctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 19132 - DNA, 5082 bp, Homo sapiens
cctcccgccgccgctgagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggcacgaagggaactgagacggctgaaggaggaggctaggaataaacatgctattgcagttatttgggcttactggcttggatctaaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcag

SEQ ID NO: 19133 - DNA, 572 bp, Homo sapiens
aaacccgcaaggcgcggaggccgccgcgacgctcaccggggggcgctgtgaagccggcaccgggcggacagagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcct

SEQ ID NO: 19134 - DNA, 374 bp, Homo sapiens
ggaagttaacttttcttaatcgggtttctacaaggtagttcactattgtatgttttatttcttaccaaaacttttcttgggaaaatttgttttattgctccatacgtggtcaagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacat

SEQ ID NO: 19135 - DNA, 542 bp, Homo sapiens
agagacgggagctacgaagggtggtggggccgggaagagagttggggagagggttgggagagggtgatgagagcgcgctggagagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctgg

SEQ ID NO: 19136 - DNA, 2672 bp, Homo sapiens
aattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattg

SEQ ID NO: 19137 - DNA, 1176 bp, Homo sapiens
gccgggctcctcccgccgccgctgagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgaaagtaaa

SEQ ID NO: 19138 - DNA, 1310 bp, Homo sapiens
tttcctcagttagattgcacatgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttgctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaa

SEQ ID NO: 19139 - DNA, 4946 bp, Homo sapiens
agaggcctcccagtcagacctggacggctccagccgtgtcctgaggagctggaccagccacatcccctggggctgcagttgaagcagaaccaagtggccatcccggcgttagaccgtaggttcctggtcccggagtggtcggagcccgccagtgggcaggcagctcttgctcacaggccgcggtgcccaggccgctggctctccgcagggcggaatggcgctgcaagtggagctggtacccaccggggagatcatccgcgtggttcatccccacaggccctgcaagcttgccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggtgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaa

SEQ ID NO: 19140 - DNA, 4734 bp, Homo sapiens
agagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggtgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgcc

SEQ ID NO: 19141 - DNA, 4719 bp, Homo sapiens
acccggagcgcgggcagcggagcgggcgccaggccggccgggcaggatgcgctaccgggcgtcggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggtgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgcc

SEQ ID NO: 19142 - DNA, 3013 bp, Homo sapiens
aactttcccgggactcgagttcgggggttgggggaggaaaatcccgcttcctctgggacccgcaggcctcggtgcccgcccagcgcccaggcccgccgcggagtgtagtcccaggcccggaagccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggtgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagg

SEQ ID NO: 19143 - DNA, 4673 bp, Homo sapiens
atgcgagggagggcctccgccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggtgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgcc

SEQ ID NO: 19144 - DNA, 3664 bp, Homo sapiens
aaatctgggcctttcgtggtcagaggacaccggcggcccctttgggatccacccccaatcaccaccaccttgttcttctctgaccctggatactctgggtgtccattttttggagccctgagaccctgtttgaagagggatccatctcagccctggttgtggggcgagggtcttgctcagcctgcaccaccctccaccctccagtaggacccagaggcagctgggctttccatggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggtgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatg

SEQ ID NO: 19145 - DNA, 5182 bp, Homo sapiens
cgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccactctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatctt

SEQ ID NO: 19146 - DNA, 3481 bp, Homo sapiens
gaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtggtcctcttatagatacctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatctt

SEQ ID NO: 19147 - DNA, 6193 bp, Homo sapiens
atttatggacagattgcccggcccgagccgagactcagccagaggagtacggattaagtggccgaagaaagaggagtgaggcaggggagcgaggcggacgctccgagcgcatcggactcacctgggccggcggcgaccggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcagggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctaggtcagtccctgcagactcttctcaactctttccctataggaaacttactccgcgtcctgcccccacctcctaaataaataaaggaatcggcgaacaccttcttcttttatgacatttgttatgggttgaattgtgtgcctccaaagaagatgttggagtcccagccaccagtacctcacaatatgaccttatttggaaatagagtctttatggagcaaacaaacaaaactaattaaaatgaagtcattagagtgggtcttaatccaatataatggtgtcctgatgaaaaggggaaatttggacacagagaccaacatgccagaggaaagaccatgtgaaaaggcagggagaagacagccattcacaagccctggacagaggcctggaacagattctccctcacaccctcacaaggaaccagccctgcccaccttggtcttggacttccaacctccagaactgtgaggcaatacatttcgctgtttaagccactcggtttgtggtagtttgttacggcagccctaacaaactaaaacaatgttttcttgccataatagtgaaaagctggaatcagtgtaatgcccatcaataatggaatggttgtaagtagagactgccatttctctacctttcctcctctgggtgccatagccattcttaagctactggtaacttagagtttgagcagcatacacctttgaggctttcaggatcctcaagtccatgggaaaaaattatcagggcttacgtataagggaaaaaaattgatctagatttgaaacgaagatacatttaattctgctgtgttttacttcaagaacagggagcaaactccattctgtaacagtaacgaataatgttaaaaggctacttcagttccatgttgcgaccagagaggaaagtagagccatgatgcggtgagttgaggaaaggtaatcctgttgacactagtggtctctaaagtactttcacattcatggactccccgcagtgggaggaagataccaccagaactgggacagaggagcatgctggagtccccacagccaccagcactcaggctgcgttctcagggcaggaacaccaggaccatcttcccttgttatcataagcccctggctggctgggacaagcctttgtttttcctcctgattgattgattggcattttacacttgtgtgtaactgggaaccatcgggctctaggtcacaaaacagggactgagttaaacccccacgagtaacaccctcatccatggaaatcacagaccaagcccttagcacctgcatcgtgtgcccagccagtgccaggctcaaggagatgcccaacaaatggtgctgaaataggtaagtgacccacaggggaaggagacttagatctgcgtagagatgctgaaatgctgacactattaagaaaagtttggagaaatagtggtttatcttaaacttatttgtatatatttagaaattcaacatggggactaccagaaaaatctgggataaataacatttccctttttttcctaattaaaaagtcttcagaaaaa

SEQ ID NO: 19148 - DNA, 4284 bp, Homo sapiens
atcaagttctgacccctcccttcaggctcagagccccaaacagccagctccccgcccccctccacacccagcttccctcccccatggcctcggcccctcccgccaaaggaagtgagaaggggctgttgtaagaggaactaaagccgggagtccggtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaagtcccgcgtggtcatgcaaaatgaaaatgagaggaacttccacatctactaccagctgctggaaggggcctcccaggagcaaaggcagaacctgggcctcatgacaccggactactattactacctcaaccaatcggacacctaccaggtggacggcacggacgacagaagcgactttggtgagactctgagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaaggtctcctacgacgtcagcggcttctgcgagaggaaccgagacgttctcttctccgacctcatagagctgatgcagaccagtgagcaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagaggccccgagactgggaggagaacagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaagcccatcaagcgggacttgatcctgacgcccaagtgtgtgtatgtgattgggcgagagaaagtgaagaagggacctgagaagggccaggtgtgtgaagtcttgaagaagaaagtggacatccaggctctgcggggagtctccctcagcacgcgacaggacgacttcttcatcctccaagaggatgccgccgacagcttcctggagagcgtcttcaagaccgagtttgtcagccttctgtgcaagcgcttcgaggaggcgacgcggaggcccctgcccctcaccttcagcgacacactacagtttcgggtgaagaaggagggctggggcggtggcggcacccgcagcgtcaccttctcccgcggcttcggcgacttggcagtgctcaaggttggcggtcggaccctcacggtcagcgtgggcgatgggctgcccaagagctccaagcctacgcggaagggaatggccaagggaaaacctcggaggtcgtcccaagcccctacccgggcggcccctgcgccccccagaggcatggatcgcaatggggtgcccccctctgccagagggggccccctgcccggagatcatgtctggagggggcacccacaggcctccccggggctccgtccacatccctgggagccagcagacgaccccgggcacgtccgccctcagagcacaacacagaattcctcaacgtgcctgaccagggcatggccggcatgcagaggaagcgcagcgtggggcaacggccagtgcctggtgtgggccgacccaagccccagcctcggacacatggtcccaggtgccgggccctataccagtacgtgggccaagatgtggacgagctgagcttcaacgtgaacgaggtcattgagatcctcatggaagatccctcgggctggtggaagggccggcttcacggccaggagggccttttcccaggaaactacgtggagaagatctgagctgggccctgggatactgccttctctttcgcccgcctatctgcctgccggcctggtggggagccaggccctgccaatgagagcctcgtttacctgggctgcaatagcctaaaagtccagtcctttggcctccagtcctgcccaggccctgggtcaccaggtcactgctgcagcccccgcccctgggccctggtcttcctccaacatcacacctgctgcccattctccatttctgtgtgtgtcaaaggggactaacagcagaatctacctcccaactgccatgtgattaagaaatgggtcttgagtcctgtgctgttggcaaagtgccaggcacagttggggaggggggggtccttaacaagcgtgactttgctcattctgtcatcactaaggcaataaacctttgccaggtgaaagcacgagttaacttactaagtgcccaacaaggacgatgttttcacagccctgtgaggtaggagctgtgaaggaccccatcttacaggtggaacaatggaggttcagagaggttcactgacccaagactgcacagagccatgccttgcattcatatgtgaccataaagcttgaatttgtcccagtttgggctgggcgcagtggctcacgcctgtaatcccagcactttgggaggctgaggcgggcagatcacgtgagaccaggagttcaagaccagcctggataacacagcaaaaccctgtttctact

SEQ ID NO: 19149 - DNA, 3827 bp, Homo sapiens
gtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaagtcccgcgtggtcatgcaaaatgaaaatgagaggaacttccacatctactaccagctgctggaaggggcctcccaggagcaaaggcagaacctgggcctcatgacaccggactactattactacctcaaccaatcggacacctaccaggtggacggcacggacgacagaagcgactttggtgagactctgagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaaggtctcctacgacgtcagcggcttctgcgagaggaaccgagacgttctcttctccgacctcatagagctgatgcagaccagtgagcaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagaggccccgagactgggaggagaacagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaagcccatcaagcgggacttgatcctgacgcccaagtgtgtgtatgtgattgggcgagagaaagtgaagaagggacctgagaagggccaggtgtgtgaagtcttgaagaagaaagtggacatccaggctctgcggggagtctccctcagcacgcgacaggacgacttcttcatcctccaagaggatgccgccgacagcttcctggagagcgtcttcaagaccgagtttgtcagccttctgtgcaagcgcttcgaggaggcgacgcggaggcccctgcccctcaccttcagcgacacactacagtttcgggtgaagaaggagggctggggcggtggcggcacccgcagcgtcaccttctcccgcggcttcggcgacttggcagtgctcaaggttggcggtcggaccctcacggtcagcgtgggcgatgggctgcccaagagctccaagcctacgcggaagggaatggccaagggaaaacctcggaggtcgtcccaagcccctacccgggcggcccctgcgccccccagaggcatggatcgcaatggggtgcccccctctgccagagggggccccctgcccctggagatcatgtctggagggggcacccacaggcctccccggggccctccgtccacatccctgggagccagcagacgaccccgggcacgtccgccctcagagcacaacacagaattcctcaacgtgcctgaccagggcatggccggcatgcagaggaagcgcagcgtggggcaacggccagtgcctggtgtgggccgacccaagccccagcctcggacacatggtcccaggtgccgggccctataccagtacgtgggccaagatgtggacgagctgagcttcaacgtgaacgaggtcattgagatcctcatggaagatccctcgggctggtggaagggccggcttcacggccaggagggccttttcccaggaaactacgtggagaagatctgagctgggccctgggatactgccttctctttcgcccgcctatctgcctgccggcctggtggggagccaggccctgccaatgagagcctcgtttacctgggctgcaatagcctaaaagtccagtcctttggcctccagtcctgcccaggccctgggtcaccaggtcactgctgcagcccccgcccctgggccctggtcttcctccaacatcacacctgctgcccattctccatttctgtgtgtgtcaaaggggactaacagcagaatctacctcccaactgccatgtgattaagaaatgggtcttgagtcctgtgctgttggcaaagtgccaggcacagttggggaggggggggtccttaacaagcgtgactttgctcattctgtcatcactaaggcaataaacctttgccaggtgaaa

SEQ ID NO: 19150 - DNA, 3267 bp, Homo sapiens
actttacaccagcactggaggaggctggtggggcagggcgggggcggtggggcctcccctagccttccctccccctctccttcactgtccttccagcaggcacaggaaggtgaggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaaccccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacatgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcaggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtc

SEQ ID NO: 19151 - DNA, 5581 bp, Homo sapiens
agggagcgcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggaatccacccccaaaactaaggcagcctgagctatggtcagcagaattcaatgacttcataagcaagtgcttgactaaagattatgaaaagcgtccaacagtgtcagaacttttacagcataaattcattactcaaattgagggcaaagatgtgatgctacaaaaacaactaacggaattcattggcatccatcaatgcatgggaggcacagaaaaggccagacgtgaacgtattcacacgaagaaagggaacttcaaccgacctctaatatccaatctgaaggatgtagatgatttagcaaccctagaaattttggatgagaatacagtctcagagcaacttgagaagtgttattccagagatcagatctacgtctatgtgggagacatactcattgctcttaacccttttcagagtctgggtctttactccacaaagcattccaaactatatattggatcaaagagaactgccagtcctcctcacatttttgcaatggctgacttaggatatcaatctatgataacatataattcagatcagtgcattgttatttctggagaaagtggtgctggaaagactgaaaatgctcatcttttagttcagcagctgacagtgcttggaaaggctaataacagaaccttgcaagagaagattttacaagtgaacaatttggtagaagcctttggcaatgcctgcactattataaatgacaattctagcagatttggaaaatacttagaaatgaaattcacctcttctggagcggtagtgggagcacagatttctgaatatctcctggaaaaatcccgagttatccaccaagctattggagaaaaaaattttcatattttttactacatttatgctggtttggctgaaaagaagaaactagcccattacaaactgcctgaaaataagcctcccaggtacctacaaaatgaccacctcagaacagtacaagacatcatgaataatagtttctataaatcccagtatgaattaattgagcaatgtttcaaagtcataggttttacaatggagcaacttggtagtatatacagcatactcgctgcaatcttgaatgttggcaacattgaattttcttctgtggcaactgaacaccagattgacaagagccacatttctaatcatacagccctggagaactgtgcttctttgctttgcattcgggcagatgagctacaagaagctctcacctcccactgtgtggtcactagaggagaaacaattatacgacccaatactgtagaaaaagctaccgatgtcagggatgccatggctaaaactttatatggacgtctctttagttggatagtcaattgcattaacagtttgttgaagcatgactcatcaccaagtgggaatggtgatgagctgagcattggcattcttgatatatttggctttgaaaatttcaaaaaaaattccttcgagcagctgtgcattaacattgcaaatgaacaaattcagtattattataatcaacatgtgtttgcatgggaacagaatgaatacctaaatgaagatgtggatgctagagttattgaatatgaggataactggcccctcttagatatgtttctgcaaaagccaatgggtttactttccctacttgatgaagaaagtagatttcccaaggccactgaccagactcttgtagaaaaatttgaaggtaacctgaaatcacaatacttctggagacccaaaagaatggaacttagttttggaattcaccattatgcaggaaaggtcctctataatgcaagtggattcttagccaaaaacagagacactcttcctactgacattgtgctacttttgaggtcatccgacaacagtgtaattaggcaactagtcaaccaccctctgaccaaaacaggtaatctgccacattctaaaactaaaaatgttataaactatcaaatgaggacttcagaaaaattaatcaacctggcaaagggcgacactggagaagccacacgtcatgccagagagacaaccaacatgaaaacacaaacggttgcatcatattttagatattccctgatggatttgttgtctaaaatggtggtgggccaacctcattttgtccgttgcatcaaaccaaatagtgagcgtcaggcaagaaaatatgacaaagagaaagttctgctacagcttcggtacacaggaattctggaaacagcaagaattcgaagactaggattctcccatcggatactttttgctaactttataaagcggtactaccttctctgctacaagtcgagcgaggagccccgcatgagccctgacacctgtgccaccattttggaaaaagctggtctcgataactgggctcttggaaaaacaaaagtgttccttaagtattatcacgtggagcagttaaatctaatgcgaaaggaagctattgacaagcttattttgattcaagcttgtgtcagagcattcttgtgttcaagaagataccaaaaaatacaggagaaaaggaaagaaagcgctataataatacagtcagctgcaagaggacaccttgtcaggaaacaaagaaaagaaattgttgacatgaaaaacacagcagtaacaaccattcaaacttctgatcaggaattcgactacaagaaaaactttgaaaatacaagggaatctttcgtgaagaaacaagcagaaaatgcaatctctgctaatgaaagattcatttcagctccaaataataaaggaagtgtatctgtagtgaagacttccactttcaaacctgaagaggaaaccaccaatgctgtggagagtaacaacagagtgtatcagactccaaaaaaaatgaataatgtgtatgaggaagaggttaagcaagaattctaccttgtagggccagaagtaagccccaaacagaagtctgtcaaagacctggaagagaacagcaatctaaggaaagtggagaaagaggaagctatgatccagagttactatcagaggtacacagaggagaggaattgtgaagagtcaaaagcagcatatctagaaaggaaggccatatcagaaaggccaagctacccagtgccttggttagctgaaaatgagacttcctttaaaaaaactttggaacctacacttagccaaaggtcaatttatcaaaatgcaaacagcatggaaaaagaaaagaagacatctgtagttacccagcgtgcaccgatatgcagccaggaggaaggcagaggccgtctgaggcatgagacagtcaaagagaggcaagttgaaccagtgacacaggcccaggaggaagaagataaagcagcggtattcattcagagcaaataccggggttacaagagaaggcagcagttgaggaaggacaagatgtcttcttttaagcatcagaggattgtcacaacaccaacagaagtagcaagaaacactcataatttgtattcctatcccacaaaacatgaggaaatcaataacatcaagaagaaggataacaaagactcgaaagcaacttcagaaagagaagcatgtggtttggcaattttttcaaaacagatatcaaagttatctgaagaatatttcattctgcagaaaaaattgaatgaaatgattttgtcacagcaactgaagtcactttatctgggtgtctcgcaccataagccaattaatagacgagtttcttctcagcagtgcctctcaggtgtctgtaaaggagaggagccaaaaatattgagacccccaagacgaccccggaaacccaaaacattaaataaccctgaagactccacatactattatctacttcataagtcaatccaagaagaaaaacgaagaccaaggaaagacagtcagggaaaattattagatttggaagatttctattataaggaatttttgcccagtcgttctggaccaaaggaacatagccctagtttaagagaacgaagaccacagcaagaactccagaatcaatgtattaaggctaatgaaaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaaccctgtccttgttcccctaatctatcactttgttctttttttttgtgactcctgtggactccactgcgcctgggatctcgccaacccctctctcatttggggtgactgaattcacagatttttttttttattggaaacggcttttcttggccaacagaacacttgctagcggttgaatcttagagaaaaaagcccgggaggggtggggagaatttcgaagatgtatttcatctcaagcttgctctttctcttcctttggttattaaggtcactaaataaaggaagtgccttgga

SEQ ID NO: 19152 - DNA, 727 bp, Homo sapiens
aaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtcagatagagttttgaggcagacaaacgtaatagctgatcctgtttgactttcctttttatgtgtactctatctctgtaagcattttggaatataacagaagaaactctcagttgtgttattttcatgtg

SEQ ID NO: 19153 - DNA, 2723 bp, Homo sapiens
gcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggtcagatgactaacattgggtccagtatctgcagcccgatttacttcctccagccaccaagtgttcatcatgctcttcatggagacgttcagatatattccaacaagttgggagcagaagatcctggaatattattctgcttcttctgagacattgtatttgttcagtagttgcatttccctggtctaagtaaaagagctttctcttgataatcagtgtgtctttctctcttttgctaggatttgatttcagaaaatagcagttcctcccaccctttatccattccccaatgagtcagtgaggcatcagagtccatagcctgtgcaagtgttttgctttgctttacctaccaatctagtaattttttactacttgctaagatttccctttgttcagaactttaaaataatattattaagaaaattatatataaaatttatccagaaaataatggttttaaacatgttagtattttgaatatgttaatataaaacaataaatttagaagaataacctcttttggtgccatgaaagcacttgactatttatgtggccccccactccttcatgtgtgtttcaacagattttcccctactatcctataaactaatttctttaaacactattttctatgagtggtggttagtcccttgatgtttcagataactaatgtgaaaagactgcctatatttattaaaggtgttatttttaaatatctttttaaggattttgccttaattataatgcagtgcacagccagagcctgtggtgacagggttccaaaacattagaatatttggcatctaactaaattattataagactaaaacatttgaattcatttttaattttgcctttgaatttcttgtcctatctagatgttccaaattataataccttggctatatatcatcctttacatactgcttattttgttaagtggagaaacaacattatggaaaagaatggaaaacctctatactaaatccaagacatttcattaattttgaagaaagcaggaaaaaaatctgtagtttctaattcctattgtcattcagtatgtaaggtgaagttctgtactgccttagctgttttaactgtggattaaaccatcatatttagtctgatgttattactcttgatgataatgccacatgaaggaaggatgacactgttgatagatattgtacctaggtaacaggcaatgtgcaaagtaattctagaaactgcatcatcttagttatttcttaattatgtctaccagcagtggaattccaagaatactgactatggtaatatggagaaaaagggaatctgaaaagctacccagttctgagtgttctgaaataatccaaactttgttattcaaagcaagccaataaatctcataaaaggaaattttcaggaggacaagaaacaaaacaacatttctggagaaaagaattacttcttttaatgtgcaaattagcaatcttcaaattgtcctaaggattgtgaaatgagcttagtcctgatctggggtagatgagtagctgcacttttctttaatgagcctgtacaaactgtacattaatttcattataagctatttaaggagtaatgcagaactgaagacaaagtatttccatttcactaatgaaaacaaagagctgttagaattaacataaagcagcacttcagcaaattcaactatcatggttgatcaatgttgcttgattacagagttagatcagcctcattttcaaatgatgttcctttgtattcaacgaatgtgccaaaaaatatatttgttcagcttaaactgaaaggaattaataaaattgttaaagttgt

SEQ ID NO: 19154 - DNA, 2203 bp, Homo sapiens
gcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggaatccacccccaaaactaaggcagcctgagctatggtcagcagaattcaatgacttcataagcaagtgcttgactaaagattatgaaaagcgtccaacagtgtcagaacttttacagcataaattcattactcaaattgagggcaaagatgtgatgctacaaaaacaactaacggaattcattggcatccatcaatgcatgggaggcacagaaaaggccagacgtgaacgtattcacacgaagaaagggaacttcaaccgacctctaatatccaatctgaaggatgtagatgatttagcaaccctagaaattttggatgagaatacagtctcagagcaacttgagaagtgttattccagagatcagatctacgtctatgtgggagacatactcattgctcttaacccttttcagagtctgggtctttactccacaaagcattccaaactatatattggatcaaagagaactgccagtcctcctcacatttttgcaatggctgacttaggatatcaatctatgataacatataattcagatcagtgcattgttatttctggagaaagtggtgctggaaagactgaaaatgctcatcttttagttcagcagctgacagtgcttggaaaggctaataacagaaccttgcaagagaagattttacaagtgaacaatttggtagaagcctttggcaatgcctgcactattataaatgacaattctagcagatttggaaaatacttagaaatgaaattcacctcttctggagcggtagtgggagcacagatttctgaatatctcctggaaaaatcccgagttatccaccaagctattggagaaaaaaattttcatattttttactacatttatgctggtttggctgaaaagaagaaactagcccattacaaactgcctgaaaataagcctcccaggtacctacaaaatgaccacctcagaacagtacaagacatcatgaataatagtttctataaatcccagtatgaattaattgagcaatgtttcaaagtcataggttttacaatggaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttc

SEQ ID NO: 19155 - DNA, 6231 bp, Homo sapiens
ctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctgcctttccacattacggatgtaacttttatgggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaataatgataatacaaaaattagcccagcatggtggtgcatacctgtaatcccagctactcaggaggctgacgcaggagaatcacttgaacccgggaagcaaaggttgcagtcagctgagagcgcaccactgcactccagcctgggcgacagggcaagactctgtctcaaaaaaaaaaaaaaaaaaaaaaaaaagagatagtatgcaagaagacacctaaattttgagagaaataaccttgaagaaaatcttgttatcagagttttgaaagggagcacattaataggccttttatgaagataaataatgaaatgaggtatttaaagatctcagaaattgtaattttacaagtaaaataaatatagccaatttttcaatagctgaacttcacccaaaaggtaatgtttataagtagagcagaaaaaatgcagataaattttattttattgtttaaaaaataatgtgtagaatatataaattttttatgttactgttaatatacgagtgcttttggaagtttcacttttgtcactgattgtctacttttggtttgataatatgagctgcttttcaaattgttgaatggaaatgttcataactccctgcttgtccgtgcacaatgtaattctaaacctggcttgtttctcatttaaatatatctataaataaactt

SEQ ID NO: 19156 - DNA, 6084 bp, Homo sapiens
atgctgcagagtgctttactttcaacaaggaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaataatgataatacaaaaattagcccagcatggtggtgcatacctgtaatcccagctactcaggaggctgacgcaggagaatcacttgaacccgggaagcaaaggttgcagtcagctgagagcgcaccactgcactccagcctgggcgacagggcaagactctgtctcaaaaaaaaaaaaaaaaaaaaaaaaaagagatagtatgcaagaagacacctaaattttgagagaaataaccttgaagaaaatcttgttatcagagttttgaaagggagcacattaataggccttttatgaagataaataatgaaatgaggtatttaaagatctcagaaattgtaattttacaagtaaaataaatatagccaatttttcaatagctgaacttcacccaaaaggtaatgtttataagtagagcagaaaaaatgcagataaattttattttattgtttaaaaaataatgtgtagaatatataaattttttatgttactgttaatatacgagtgcttttggaagtttcacttttgtcactgattgtctacttttggtttgataatatgagctgcttttcaaattgttgaatggaaatgttcataactccctgcttgtccgtgcacaatgtaattctaaacctggcttgtttctcatttaaatatatctataaataaactt

SEQ ID NO: 19157 - DNA, 5529 bp, Homo sapiens
ctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaa

SEQ ID NO: 19158 - DNA, 5448 bp, Homo sapiens
ctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaa

SEQ ID NO: 19159 - DNA, 3863 bp, Homo sapiens
gcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggtgcggcgggggatgtgcctgctcaggccgggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcaggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaattatccttttgcaatcaacatgtag

SEQ ID NO: 19160 - DNA, 12409 bp, Homo sapiens
gcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggtgcggcgggggatgtgcctgctcaggccgggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaaacaaaaaaaaaaaaacaaaaaaaaaccgtgattgtttccattaagccatcagagcgtgtctcagatatcttgttatacagtgaagaagagaatacctattttttttgatgatgtttgatgtcatagtaatcagtgctggtttaactcctgtttagttcctgccaaatacattgcatgggctgaagtgtcagtagccatactgttctcatgtttcttggtcctaggatcagattcttctacattattttttagtttcccagagacatggtgatccctaaacttatgaaggtttcatcctaagccattcaggcttttctctttgtatagattaaaccgaaaaccgcatatgagcctgttcatctgctggtggattcccaccacagactcagactcaaacaaacaaacaaataatgtgaccgtttagttagtttccaaaaacattcacatacaatattgcatgaataagtaagtaagtgttacagaaagctgccaaaaaataaaaaggtttttaatatgacctatctaactaactaacttttatcttccttttctcagactatcagtattaaatagatggaaaaaaatcaaggactacttgaagctatttttgttaatattctggttactgaagtttattgtaaatatgtatgtatagtaggcatatttctttttaaccttgtgcttccctccttcccatggaatttcttcccacagatgaggggccactggacagggggatgagagccattcgtccctgggttgagggaattagtaagacatcattttcaccactgggtggtcttcatacacatgagttataatagcattttaagtatcttagcatttgtgggattagaaatctgtttttgctatttataatatataaaaaatgaaacatgatagcctttcttgagataagtatgtgaaatgtttatttttaaagttactaaatgcatcttgtcttgctactacatgcactgctctgaaaaagagcctttaccatctataacctgtattttgggtattcttccttttcatacttctttgaagttgtggaaatattaagtcttttgttaaggcagagtctctctctcctgttacacaacactgaacctcacgccactgcctcagtggttattggccagccccagaggttagacttggagcataattctgagtggcagctaaaggtagcaggagtcttacctctccctactttgggttcagaattgagccagagaaaggaagccattaaaatctccagaataatgatagttaatgagcaaatgttatgctttatatcccacagacatctgccaccttgttcatcttgtcctgaggagtaataaataatgttaagcttttaaaaatctgaatttcagagaatctcctagaggatagaggaaaacccctcagcatggtgtgttagagtgggattgctggttcctcagccccgtgccaggttgcacagtctgtgtttcagtgttcttgggagagtagtgtactgctgggcattaattgttactctgcacttgctccagaatgttggttaaatcctgtatgaaaaaaagagattgcccttatggaataatttcctgtggcccagaggaatggccagaagaacatatgttggcacatgttcttccttctaaatctttgtggggcttttttggcaaaataagttttttggcagttaaaaaacgactgatgtaggtcactttaaaggaactaggtgatggatgttaagagactttataatttttctcagggacctgaaactccagtttggataaaattcaattaaaaaaacttgttttttcagttgctagatttgtggatttctagtaatttaatctgccaggattggggtgggtgggtgaggaggagagagccacaaaatgataagagtggagagcagtgtggggccctccctttgagggaaagccgttgtttacatagggtagtaggccttgttggcctgatcaagagatgaagccataactcttaaaaaccttcagaaccaaacgctgtgtctgcatccatctgttctcactggccctctgcatggtaaagttatgtcaccacaaagtgatgccgcattacaatcacttatgaaactgttagcccttaatatgcatcacatttgtggttccatagtgcttctcctttgcttgtttgatctctgcatggcagcagtggggcagctccacatttggagcccatactccaaaatgcagagcactcttctcacagcacacattcccagccccaaacaaaacctgaattttcaactctgcccattaaagtgaatgtatccctgtaatttagtatgtacttattatggaaaatgtaacaaaagcagagaagtgtgatttcattctgtatcacaaattgaagcaaatcaacagcaaatacagcaggattcagggaggcttagtttacaacgtactttgtacctcctgccatttaaattattttgccactctgggcttctgaaaacacaaagggagatacagccctccaactatgagccttgcagagagagacaaaagggccagaggtcctgggatggaatactagagcccccaccttctcatgctttggaaacctgccagagcacttaccctgctggaagattaatgaagactccattctgtgtttcataacagtagcgttgttttctccatcaaaaacagagggtcacagaaatgtgctgaaaagatgtggtccagcaaggttctgtagtcccacctcagtgcctgtgggctgtgtttttcactgtaacaagcactttggtaaactagaaagaagaaaggattctcaggatgtgttcaaagctaagagagttttcattttaaaaagaaacatacatactcactccatggctttcctcatcctcctctcttttttcttcttggtgggaagctggatgcggggcatgcatcattctgtatggacaaatgtgttatgtccacccatactcttgtgacaactccccagcactgtcctgcaataccatgctggccttggtagtaaaactccttggtatctgtgagagtcctctttttctatgccctagactacttttaaccacttttctctggaatgactcccacatttgattgggtattgaaagggtaacagcaaaatgatgattgtggagatggatctattaggtctcatgttggtcccctggttgaaactattttcaaaaaagccccaacaatgggcctgtcaccttgctagtcatccattcttaatgcctatttatcagccctctgaggtcatataaaagttgcaccttttgaaccaagtatttgtatttactatgggaaaggtgtggactacagattcgtattatattattttaatggattttaagtaatttataagtatgctgagtgtaaattttttttaaaaactgtattataaaaggacatatcctgtgaaatataacattttactgtttaatagaataattctataagaagaatgatttatctcacccacggaactgattacattccggatgcaatcaataggcactttgtaatttcctttttgtttttttttctttgctggggggttgaggggtaacaagataccatctgtataaagtgcagtttgtgtcactcaaaatatgcactgtatggctacacaaaagcagcttgatgaacaaatcaccccatggctcattaaagaacaaagcttccagaagca

SEQ ID NO: 19161 - DNA, 8885 bp, Homo sapiens
gcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggtgcggcgggggatgtgcctgctcaggccgggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagc

SEQ ID NO: 19162 - DNA, 8615 bp, Homo sapiens
gcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggtgcggcgggggatgtgcctgctcaggccgggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcaggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagc

SEQ ID NO: 19163 - DNA, 4008 bp, Homo sapiens
gcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggtaagtagtagttattagtattctaccatacttcatctttttttttttttttacctttctacttctccacaaaaaggagtagaattcttgctatgagattctcaaggacaaaaatcctgcttctgtagtcaatctagtgtcatctcttaactgatttgtgactatgaacagtttttcttttctgtaaaagagttatactgcctttaaaataatgaggataaagtcagagcatctgttcatgaagtgttcattttcttttcctttactcttagttcatggatttttaaaaactttgaaatttagaaatagataaagcaggatactttttctgtatgcctcccccttcaatcataaaatctctcatctcattttctgtgggagggcaacttcataagcacttttggcctactggaaaccaaactattgtttgctgtagctctagtcttagatagggccattgctgcatagagaagattttgtgatacatatgcagttgagatttatgcctttcagtagaaatgttatagggctcacctgtgctttcaggactcccaaagtgatttacgtggctttttgggatgtgcactagtagtaaaacttttaagtttagcttttaaatgtttgagacaaatagatatatttgagagagtgtatttctaaaaatacatgtaaaataattgaacctagtttccattttttagattgtaaagtatttgaactggtctttgtagatgtatagggagaattatagtttattagagaaataaaaggactatctcaaacctgctttgccttttacaaagtgatttctaagaggttatctttgtaaaaagctttaaggaaaattttttttctttaagatgctttcttgtttattatgacaaacttctaatcaagaaaaccactcaaaattgattagcatcctgctaagacataattgagtaagagaagaaacttttcttgtatttactgtcaaagcctatttactttattcacattatctgtatattcctttggcatttaaaatctattatttgtgaaagctagttgttacatatctgttattatcaatatcggcaatgacatgcaatgttattaatgataaacaacctgtattttctctaccttgataaagtctagattccttattttctaatcttgttttcccttctggctagtacagagcttccatataataatctctttttgaaaatttgtattcaacataacatgcatatacaaaagtacacaaagcaaaaatgtatagttcagtggagtaccacaaagtaaacacaaccctggaactaccacctaggttaagaaacacaacattccagccacccaaaatttctccttggaaaaaactttaaaatttttacttttt

SEQ ID NO: 19164 - DNA, 7520 bp, Homo sapiens
ctagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttctggcggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaagcaagacatcacctaccggctgccggagctggacccaaggggctcggacgaggagaacctggactcggagacgtcggccagcaccgagagcctgctggaggagcgggccgggcggggggcctcggaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgc

SEQ ID NO: 19165 - DNA, 7532 bp, Homo sapiens
ctagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgc

SEQ ID NO: 19166 - DNA, 7623 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgca

SEQ ID NO: 19167 - DNA, 1249 bp, Homo sapiens
ggcgggaggagggttggtggcgaggccctggcccggacgtccaggggccgggaggctgcaggcgatggagccggtatggggagacgccctgctggagaagtggccgggtcccggccgtgcgtgggccggccctgcgccacctgggtgacctcagacacctgggccttggacggcccggctgcccggcggccaacgcctgccctcccggcgccgcggcgggtcctggcggtggattggggccgacccgggcgtgttcgtgtggagcacctgccctgtgcccaacactatcctagatgctttggagggtggaggagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 19168 - DNA, 2787 bp, Homo sapiens
ctcctgagcagccgctgggagacagacggcaaccaggttgcccctctttgctccagctagaaagacttgagttagacaagcagcagcacacgcctccctacctcatggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 19169 - DNA, 2956 bp, Homo sapiens
actgcccacacccctgcctccgcctctgcccacccggcccaatcccttacaactgcccaggactgctcctgagcagccgctgggagacagacggcaaccaggttgcccctctttgctccaggtacctctctcccctcagttagcaggcctcggcttcctgtctcactgcagccagacgagaggggaaattggacagcctgacacactccactcttgtttctgcagctagaaagacttgagttagacaagcagcagcacacgcctccctacctcatggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 19170 - DNA, 2765 bp, Homo sapiens
aggagtctgtcagctacggaggacaatgaccttgcagacaccaccgcctgagtgagaaccaggggtctgtgcctctcctcattccccgctcttgcccttgtcaagcctgcaccagcatgtcaggaacctccaaggagagtctggggcatggggggctgccagggttgggcaagacctgcttaacaaccatggacacaaagctgaacatgctgaacgagaaggtggaccagctcctgcacttccaagaagatgtcacagagaagttgcagagcatgtgccgagacatgggccacctggagcggggcctgcacaggctggaggcctcccgggcaccgggcccgggcggggctgatggggttccccacattgacacccaggctgggtggcccgaggtcctggagctggtgagggccatgcagcaggatgcggcccagcacggtgccaggctggaggccctcttcaggatggtggctgcggtggacagggccatcgctttggtgggggccacgttccagaaatcaaaggtggcggatttcctcatgcaggggcgtgtgccctggaggagaggcagcccaggtgacagccctgaggagaataaagagcgagtggaagaagagggaggaaaaccaaagcatgtgctgagcaccagtggggtgcagtctgatgccagggagcctggggaagagagccagaaggcggacgtgctggaggggacagcggagaggctgccccccatcagagcgtcagggctgggagctgaccccgcccaggcagtggtctcaccgggccagggagatggtgttcctggcccagcccaggcattccctggccacctgcccctgcccacaaaggtggaagccaaggctcctgagacacccagcgagaacctcaggactggcctggaattggctccagcacccggcagggtcaatgtggtctccccgagcctggaggttgcaccaggtgcaggacaaggagcatcgtccagcaggcctgaccctgagcccttagaggaaggcacgaggctgactccagggcctggccctcagtgcccagggcctccagggctgccagcccaggccagggcaacccacagtggtggagaaacacctccaaggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattactgaggccagtggtgaagtgaagagatgactcaaacatttaaataatttggctttttggtattattgattccacttattttgtaaaaatggttatggctgctgccttccttgtggatgaaaagtggctgtaaagaagcttcctaagaacgttt

SEQ ID NO: 19171 - DNA, 1795 bp, Homo sapiens
agagggccgaccagcagaggaagggagaccagagggcagcttgcacagatcttgtcttgggttataactgttgacaagccacttaactgcctccaggtttaagtttgtctgtgtataagatggaggtaacaatatttatacatctcactggagacttatgaaaacaagattttggacagatcccttgggacccatggatggaaagtgaataaagagcgagtggaagaagagggaggaaaaccaaagcatgtgctgagcaccagtggggtgcagtctgatgccagggagcctggggaaggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattact

SEQ ID NO: 19172 - DNA, 4876 bp, Homo sapiens
gctgctgctggagagctgtgagaaggagaagcaggcattgctgcagaacctaaaggaagtggaagacaaggccagcgcctatgaggaccagctgcagggtcaggcacagcaggtggagaccctgcagaaggagaagctgagcgccactttcgagggcagtgagcaggtgcaccagctggaggagcagctggaggcacgagaggccagcgtgcgcaggctcgcagagcacgtgcagagcctctgtgacgagcgggacctcctcagacagcggttccaggagctgacagagcgcgtggccacgtccgacgaggatgtggctgagctccgggaaaagctgaggagaagagaggctgacaaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaagagattttaaggaaatttgcaagtgaatctccaaaggacatggaagagccacggagtacccctgaagagacagaaagggatggcactttgctcccaggccaaccagtccaagccactagggcacctctaggcctcccacacacaaggctcgaggatgaggacgaggacctgggggctcctccgggggaagagtacggtgatggcagccccagtagggaagacagcatggtgcccccaaagtcagtggaagtgcttgacagggagggccatcagcagggcacagccaaactcgaccaaggggcacctggtgttaaaaggcaaagaatccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 19173 - DNA, 3846 bp, Homo sapiens
atgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 19174 - DNA, 3134 bp, Homo sapiens
gccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctga

SEQ ID NO: 19175 - DNA, 527 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcagcaaaacacccacccccttgaaatgaaacgtggagctcacatatatgatgcacgaatgttctcatgttgaaggacaggaagaggaatggcatcagctatgagaccaccctgacccccacccgctgccccatcctacacccgaggtggcccctgaagcatgacctccagggatcttcacagtttgaagagccgctgatatactctaatacttgcagtaatattttttaatagaatgcaatattggatgtacacaaaaggatacaagcagcatacatttacaatataaatctaaataataaaaatgaatgctcgtgaa

SEQ ID NO: 19176 - DNA, 893 bp, Homo sapiens
gccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgatgtcttcccagtgactctccttggggcctggggaaaccacaagggagcttggattcattcacccattgctgccttgctgtgtgcctcagaggggctcagaggtggaaaataaatatgaaaaagcatccttgtcttctagaatctcgtcggctgctgggaagaccaaggggccagccatcgcagggagcataagcactgagacaggcacacgtgcctgcccggctatcgtagccaggctggcagccttgcaactccctggggaagaacaatctaggaacattctggggtgtggagcaggaagggagtgtcacatgcaaaaggcaggatcagccaaagcagaggggctgaagaagcagtgattcccccacctaatgtcagaagtaaaatcagttcatggtgaaaatttggggaaacaaaatcatgcagcaaaattgcctattaaaccccacacggaggtaaaaatcggttcatattgtggttatgtatctattctcttatgatgtgtatttatgtgcttatgtaagacctaaaaacaataatttttaaataaaccagttatttttaataag

SEQ ID NO: 19177 - DNA, 3839 bp, Homo sapiens
gccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 19178 - DNA, 4043 bp, Homo sapiens
tccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 19179 - DNA, 837 bp, Homo sapiens
agcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcagactgaagtggccgcctccccatcgggtgcctggcagaggctccatagagtcaaccaagaccttcaaagtgagcttgaagcccagtgccagcgccaggagctgattacacaccagattcagaccctgaagcgtagctatggggaggccaaggacacgatccggcaccacgaggctgagatccggagccttcaggcacggctcagcaatgcggccg

SEQ ID NO: 19180 - DNA, 746 bp, Homo sapiens
ttaagacaacagactgtggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggtt

SEQ ID NO: 19181 - DNA, 3244 bp, Homo sapiens
ctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcggcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggtt

SEQ ID NO: 19182 - DNA, 2796 bp, Homo sapiens
gcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaaacaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 19183 - DNA, 1666 bp, Homo sapiens
gggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaaacaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaa

SEQ ID NO: 19184 - DNA, 12139 bp, Homo sapiens
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggat

SEQ ID NO: 19185 - DNA, 12051 bp, Homo sapiens
atgaaatctagtagtttggaaactatgtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagttacatgagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggat

SEQ ID NO: 19186 - DNA, 10754 bp, Homo sapiens
gcctatttatggagaagatattattaatgcatacagtggtcagaacatgggtgatatggatccacatatctttgcagtagctgaagaagcttacaagcaaatggccagagatgaacgaaatcagtccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatat

SEQ ID NO: 19187 - DNA, 12225 bp, Homo sapiens
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatataaa

SEQ ID NO: 19188 - DNA, 12211 bp, Homo sapiens
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggat

SEQ ID NO: 19189 - DNA, 12139 bp, Homo sapiens
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagttacatgagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggat

SEQ ID NO: 19190 - DNA, 5989 bp, Homo sapiens
gcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcac

SEQ ID NO: 19191 - DNA, 9520 bp, Homo sapiens
gcctcctccccacacctgggaggggagtggtgcggcgcggcctcctcccccggcgctcgcaactcctgtccggccgtagctgcgccgccgcggcgggagtaaaggtcgcgccgccgggagcgagccggccgcggcgcctgcgggaagccggcggggcaggtcggagaagagcgagaagatcgagaaactccaggccagcccgggaacatggcgccaggcgggccagccgcggactgagagccgcggggcagccaggagccggggcccgagccccgcccggcccgggccatgtcggtgggcgagctctacagccagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatacctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacagcaagactgaggattggggatatttaaatgaagatggagaactcggcttggcctaccaaggcctaaagcaagttgccaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaacgaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacataatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttgacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttatttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaattt

SEQ ID NO: 19192 - DNA, 3111 bp, Homo sapiens
aggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatg

SEQ ID NO: 19193 - DNA, 2726 bp, Homo sapiens
agccctacattctgctgctgctgcagagtgatgatttttaacagaccagaacttacacatctaaatgagtgttgttgttcagtgaagtcaccttaggacaatgatttaaataacaccgcgatttctcaagaagtttggaacttctcttatggttgagttcaaagccattttatgttatatgtggcccaaacaagttttattagtacaattaaatctttattgaggacttttgatggaccacatagtgaacttggactgggaatcaaaagaatggtaaggcagggtgtctgccttcactgtgcctgcagtctggctgagatgcacatgtgagccacactagcacaagccagcatgcactggcctgtcacaagagagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatacctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatgg

SEQ ID NO: 19194 - DNA, 6971 bp, Homo sapiens
aactcgggaacgggaacaggaggccgttggaaaactttgggcaagatggcccggcggtgatttccgcggcggtctctcctgcgcccggcctctgcggcgcaggcccagcccccgagcctcgcacgttcggcagccccggcctggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgcgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagttggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattggaatgtgatttaaggaagaaaacagacttttctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcatttcaatacattgtacatgaaaaaatgaaaagtagaactttgtaatactttaatcaataaaattaattaccaaa

SEQ ID NO: 19195 - DNA, 3074 bp, Homo sapiens
gaaaactttgggcaagatggcccggcggtgatttccgcggcggtctctcctgcgcccggcctctgcggcgcaggcccagcccccgagcctcgcacgttcggcagccccggcctggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagatgggaaatctgaggcacaggacctggacctgctgactctttacctaaatctttactgcataaccccagccgcagctcctgagctccctccgctttatgtcttcgtctgtgagctggactctcagagggcacccattcctggttctgatgcttataatgagggagcaggtggtgcttacatgagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcagttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaa

SEQ ID NO: 19196 - DNA, 770 bp, Homo sapiens
gttggaaaactttgggcaagatggcccggcggtgatttccgcggcggtctctcctgcgcccggcctctgcggcgcaggcccagcccccgagcctcgcacgttcggcagccccggcctggccccggcccctcctgcccatggcggtggccgagctgtacacgcagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaa

SEQ ID NO: 19197 - DNA, 2129 bp, Homo sapiens
cggtgatttccgcggcggtctctcctgcgcccggcctctgcggcgcaggcccagcccccgagcctcgcacgttcggcagccccggcctggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcagttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtaccgtgaaggtctccatcaatgctgtcaaccccggaacctgtacagcctccagaaggagtaggcaggccaggaatgtttctgatcagattcaagtcatacttaacatgtagctttgatgagtgtgtgtttaacagttccttatttgtttttgtggcgagatacatgagttccaactgtactactttaaagacgaatgtgttgttagaagaccacacttctgattttggatgtactgaagttactgaatttcattaacctcttatcagtttattttctatatgaaattgtgataatcaagacagcataattcttccttatgatgaaagctatatttttttctgaagttctatttgattaaactggactatattacagtggcaacataggttaactcaa

SEQ ID NO: 19198 - DNA, 6076 bp, Homo sapiens
ggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaaggagtgccgaagaatttaattatacaagaatgggaggcaatactgtcattgagggtgtgaatgatcgagctgaaatggtagagactcaaaagaccttcacgcttctgggaaatgtgctaatcccctcacggtgactgaatatggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcagttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgagatgctggaggaacataaggctgtgatcctacagaaatacgcacgggcgtggctggccagacgcagattccagagtatccgacgattcgtgcttaatattcagcttacttacagggtccagcgtttgcagaaaaagttggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaaggcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattggaatgtgatttaaggaagaaaacagacttttctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatctacgtttcccaagttttatgggaactggctattccttgtcccgg

SEQ ID NO: 19199 - DNA, 5387 bp, Homo sapiens
ggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttcc

SEQ ID NO: 19200 - DNA, 5597 bp, Homo sapiens
cttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttcc

SEQ ID NO: 19201 - DNA, 8665 bp, Homo sapiens
gtgcacgccgcagtgccggggactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggaggtacttggattcctatccggtaacttctaaaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtggaaaatcagtggtggttgtgaacacttagagaatagcaatccacaggcaagaataatggtattgtttgtagagctttattaattggatattttttaaaagacattttcattcacaggtcattactatggttctcagcgatccaaatatgtagatcattggtttttttttttacctgaagtagcttaagagtacttggatcagtagaataaatatttattgaatcaatcagtcagccaattaatatgatgttagtgatagacctgcctccttttatggaagaggtaacagatccagagaggtcaagtaatttagttgtagactgaaaaatatatcaaagcctttgctgcaatcatatgtaacaaaaagaaccaaaacaaacactttttagtggcacctgtggatttacaaagggttgcctctctgtcattccacaacttcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaacagttgtaacaataaggaaagagaagagcaacagtggaagagacaggttgtgtgcccctaaagattctgcacccccagtttggaaacactgatacattttaggacacagagcactcctagatctctacgaaattttagaatgaataatgtgtaatttataggatcagaacgtatggttattaaaacttggatcaagatatgcccggtgtatacattcttagcacataggaatggcactgccatactggagaaggtcagcagtaaataggcattctgtacataagcctcatggaagggtaagatggagagactggcagaagtagcacctactctgctgggagcacttctctgagtacgctttagttcaattcaaatcactgtattctttccccattgctaacctaatatatgaaacaagcttagctgtctcagaagtttttcaagagatgatcaggaaaaattaatgcacattcaaaaggagaatcttcagtacaaatttgtttttttaaaaatagatttagggctgggcgcggtggctcacgcctgtaatcccagcactttgggaggccgaggcgggtggatcacgaggtcaagacttcgagaccagcctggccaacatggtgaaaccctgtctctactaaaaatacaaaacattagccaggcgtggtagtgggtgcctgtaatccctgctacttgggaggctgaggcaggagaatcacttgaacgcgggaggcagaggttgcagggagccgagatggcgccattgcactccatcctgggcaacaagagcgaaattccatctcaaaaaataaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaatttc

SEQ ID NO: 19202 - DNA, 5651 bp, Homo sapiens
ggggactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttcc

SEQ ID NO: 19203 - DNA, 8692 bp, Homo sapiens
gtgcacgccgcagtgccggggactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggaggtacttggattcctatccggtaacttctaaaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtggaaaatcagtggtggttgtgaacacttagagaatagcaatccacaggcaagaataatggtattgtttgtagagctttattaattggatattttttaaaagacattttcattcacaggtcattactatggttctcagcgatccaaatatgtagatcattggtttttttttttacctgaagtagcttaagagtacttggatcagtagaataaatatttattgaatcaatcagtcagccaattaatatgatgttagtgatagacctgcctccttttatggaagaggtaacagatccagagaggtcaagtaatttagttgtagactgaaaaatatatcaaagcctttgctgcaatcatatgtaacaaaaagaaccaaaacaaacactttttagtggcacctgtggatttacaaagggttgcctctctgtcattccacaacttcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaacagttgtaacaataaggaaagagaagagcaacagtggaagagacaggttgtgtgcccctaaagattctgcacccccagtttggaaacactgatacattttaggacacagagcactcctagatctctacgaaattttagaatgaataatgtgtaatttataggatcagaacgtatggttattaaaacttggatcaagatatgcccggtgtatacattcttagcacataggaatggcactgccatactggagaaggtcagcagtaaataggcattctgtacataagcctcatggaagggtaagatggagagactggcagaagtagcacctactctgctgggagcacttctctgagtacgctttagttcaattcaaatcactgtattctttccccattgctaacctaatatatgaaacaagcttagctgtctcagaagtttttcaagagatgatcaggaaaaattaatgcacattcaaaaggagaatcttcagtacaaatttgtttttttaaaaatagatttagggctgggcgcggtggctcacgcctgtaatcccagcactttgggaggccgaggcgggtggatcacgaggtcaagacttcgagaccagcctggccaacatggtgaaaccctgtctctactaaaaatacaaaacattagccaggcgtggtagtgggtgcctgtaatccctgctacttgggaggctgaggcaggagaatcacttgaacgcgggaggcagaggttgcagggagccgagatggcgccattgcactccatcctgggcaacaagagcgaaattccatctcaaaaaataaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaatttc

SEQ ID NO: 19204 - DNA, 522 bp, Homo sapiens
aaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagcttggattcctatccggtaacttctaaaaatgatggaacaagacccaaaatgacaccaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttgg

SEQ ID NO: 19205 - DNA, 6534 bp, Homo sapiens
gcactgctccagaagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttg

SEQ ID NO: 19206 - DNA, 6813 bp, Homo sapiens
gcactgctccagaagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttg

SEQ ID NO: 19207 - DNA, 3609 bp, Homo sapiens
gcactgctccagaagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggtcctgcaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccggtcagtgccgcctgaaagtcttttggtggctgagtggtgcctctgtcaacctagcaagagattaagccaagcacctgggtttggcttcgctgctagctag

SEQ ID NO: 19208 - DNA, 6903 bp, Homo sapiens
gcactgctccagaagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttg

SEQ ID NO: 19209 - DNA, 7462 bp, Homo sapiens
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 19210 - DNA, 4050 bp, Homo sapiens
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccggtcagtgccgggaggcggggacaccagggcctgaaagtcttttggtggctgagtggtgcctctgtcaacctagcaagagattaagccaagcaggcctgggtttggcttcgctgctagctagttggtggagttaggaccttggtggagttatttcatctttctaagcctctgattccttgtctgtaaagggggaatcctaaaacaggcatcccttggagatattgcaggttcagttgaaggccacagaaataaatatcacaataaagagagctgcagaaata

SEQ ID NO: 19211 - DNA, 7336 bp, Homo sapiens
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 19212 - DNA, 2532 bp, Homo sapiens
gggctgagtgtgcagtggctgctcgatgggctggcttgtttctttgcatcacttcatgtgcccctgggcagagtccagctccatgccagtgccagagggatccaggagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaaggtacaccatgggcttctcagagcagaggaggaggggaacagggcattgataaagcacagagactcctccctaggactgtgggaaagagccatggccttggacacctgccctggtgagggaaggagggcagcaccctcagccttgtcccagcttagcgtcttagctggggtaagtcctggggacagagggaccagaagaagctcagcctggcagtggaggcagacatgtaaacaggctggggtaatggaggatggcctgtgttctgacactggggagccctcgcccaggtggcagagctcgggaggctctgccgggtgtgagaaggcctcttag

SEQ ID NO: 19213 - DNA, 7106 bp, Homo sapiens
cacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcaggagaaaagctgggacttgccccacgttacacagccacactgaggcatgtgtcgtgtcacaaacgagatcttccattcaagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttg

SEQ ID NO: 19214 - DNA, 5077 bp, Homo sapiens
ggccaggctggccctggctgcctgcggcgcgggcgcctccctcgcagccgctgctgccgacgccgctgcgctcccgcctcctgtcggttcccgggttcccgctgcggctgcggttctggcagccgagcccccgcggtgctgcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatgaaaataaa

SEQ ID NO: 19215 - DNA, 3144 bp, Homo sapiens
cctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgc

SEQ ID NO: 19216 - DNA, 2678 bp, Homo sapiens
aacccggcggttccgcagctgtgtttgggagacttgggggcgcattagcctggacagctccctgatcggtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactga

SEQ ID NO: 19217 - DNA, 2664 bp, Homo sapiens
agaaacgagcagtagcactgtgctgttccttcactctggtattgctctctacccagagccctgtgtcttttcttaagaagactacctggcttatcctctgtctgggcttttctggccatgaggacatggagtgaagattttggagctctgtgccctgtgtcctggcgtttaattatttctcaagacacgtgagctaaatttgagtagaagagcttggcagaaagaaaaccaccagttacggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagact

SEQ ID NO: 19218 - DNA, 7444 bp, Homo sapiens
gggagtcagccagacccccatcctgacaaggcttgtggaactgctgactcaggatgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcagccttcacactgccgtctctcctggccaggcccccgcctgcccaagacgcaggaccagcaggagaagatgctgctggaactctctttcccagaggtcatgggtctggccaccaacaggtgcgggccctgagggaagatctcttcttacacacggagccccaccctcctgcaccaggccgtactgcccatgaagtactccattggggcatcacgcgttgcactggcagcttctctttgaaacccaggtccacccggaaggggcagggaagcgtgcagcctctggcgggcacttatttagaaggctcctttctttgtcatggacgagaactggtggcctggagggtacaggttgtctgggaaggcgacaagggacagtgcctggctggggctgacccccactcccatgggtctccatggatctcattgactgggaacttttccatgccctttgggaagtccacacaacagagtggcacatgcatctctgggctgtgccaggtgtacagtggccaccactccccactggccacctcgccacgaagtaccgacagcatcacccattctgcagatgagcggatgagtaaactgaagcacgccgaggttaggtggctcagagtaagcacatggcagagccggcagctcatctcagctctgacctttgcagtgtccctgcggtgtcactgcacaccagccacctcattatctgcccacagccaaccccacacatgggctgcaccactctcagcctccgagagacccacagtggtgtctggcctagtcctggccctggcagagcagctctgtgtcctcataaggtggagggggctcctggtcacgctgtccttcatctccagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgccacacccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcaggaga

SEQ ID NO: 19219 - DNA, 6718 bp, Homo sapiens
gggagtcagccagacccccatcctgacaaggcttgtggaactgctgactcaggatgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgccacacccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcaggaga

SEQ ID NO: 19220 - DNA, 6694 bp, Homo sapiens
tccatacaggcttgtggaactgctgactcaggatgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcaggaga

SEQ ID NO: 19221 - DNA, 6715 bp, Homo sapiens
gggagtcagccagacccccatcctgacaaggcttgtggaactgctgactcaggatgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcaggaga

SEQ ID NO: 19222 - DNA, 4812 bp, Homo sapiens
tgcacttgctacccttctgcaggaagcttcccagccagcacagtttctctctgccctgcctcttaatccccacccctgctcccaggcctgggacactgctaaccacccctccttcctgacacctctctgaccacccctcctcctcttgactggttcctctggaggtaggcatggcctcgggttctgcccccagtttctcactcgctgggctccaaaagaaacactggcttctctccttcagctccaggctagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaacc

SEQ ID NO: 19223 - DNA, 4803 bp, Homo sapiens
agcaaagagtgctgttcttgttctctgggtggattttccaagatcacaactaaactgcttgattttgtcctgggactttttttaaaaaaaaattattgattggcttttaaaatcaagaatctttgggccctgaaatgtaattacacatttgttgatgcgtgcatgatggttagtttgcccctgcagtcaaaagtgtcttcagcagttcctatcacgtcagcctcgccaggctggacttcctttgagtagaatcaggaatgaattaagcagcacagcccgagacgcaccacataaaaggctgggaacaccagccagccgaagaaagcccatttttgtgtctgtcagcttagatgcccttgcccggactgctaaagatgcagctatttacagtggacagaaactgaaggggtgaaagaaaacccaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctga

SEQ ID NO: 19224 - DNA, 4803 bp, Homo sapiens; identical to SEQ ID NO: 19223

SEQ ID NO: 19225 - DNA, 8038 bp, Homo sapiens
gccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaacacgctgtgtgtttcc

SEQ ID NO: 19226 - DNA, 4839 bp, Homo sapiens
ttctttctaatgccaggcaatcaaggctgcacttgctacccttctgcaggaagcttcccagccagcacagtttctctctgccctgcctcttaatccccacccctgctcccaggcctgggacactgctaaccacccctccttcctgacacctctctgaccacccctcctcctcttgactggttcctctggaggtaggcatggcctcgggttctgcccccagtttctcactcgctgggctccaaaagaaacactggcttctctccttcagctccaggctagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaacc

SEQ ID NO: 19227 - DNA, 11863 bp, Homo sapiens
gggctgggcctcccttccccataacactgagctgctctgctgggccaaccgtgctcctgggccagccagaggacccccatgaggcggcatgcaggcggggagcaggccacagaacgcagggtgaaacccaaggcgctctagaggagatgaattatggatccgccctcccggaatcctggctcggccctccccacgccacccagggccagtcgggtctgctcacagcccgaggaggccgcgtgtccagccgcgggcaagagacagagcaggtccctgtgtctccaagtccctgagcccgtgacaccggccccaggccctgtagagagcaggcagccaccatggcgaaggaggaagatgaggagaagaaagccaagaaagggaagaaggggaagaaggcaccggagccggagaagcccaaacggagcctgaaggggacgtcgcggctgttcatgggcttccgcgaccgtacacccaagatctccaagaagggccagttccgcagcgcctcggccttcttctggggcctccacaccggcccccagaagaccaagcgcaagaggaaggcccgcaccgtgctcaagtccacgtcaaagctcatgacgcagatgcgcatgggcaagaagaagcgggcgatgaagggcaagaagccgtccttcatggtgatccgcttcccaggccgccgtggctacggccgcctgcggccgcgcgcccggtcactcagcaaagcgtccacggccatcaactggctcacaaaaaagttcctcctcaagaaggccgaggagtcgggcagcgaacaggccacagtggacgcctggctgcagcgctcgagctcccgcatgggctcccgcaaactccccttcccgtcgggtgccgagatcctgcggcctgggggccggctccggaggttcccccgcagccgcagcatctacgcgtcaggcgagcccctgggcttcctgcccttcgaggacgaggccccattccatcactcgggctcccgcaagtcgctgtacgggcttgagggcttccaggacctgggcgagtattatgactatcaccgcgacggcgacgactactacgaccggcagtcactccaccgctacgaggagcaggaaccctacctggcgggcctcggcccctacagcccggcctggccaccctacggcgaccactactacgggtacccgcccgaggatccctacgactactaccaccccgactattacggtggcccctttgatccggggtacacctacggctacggctacgacgattacgaacccccatatgcgcccccgtcggggtactcgtctccttacagctaccacgatgggtacgagggcgaggcgcacccttatggctactacctggatccctatgcgccgtacgacgcgccatacccaccctatgacctcccataccacactccctacgatgtaccctactttgatccctacggagtccactacaccgtcccctatgccgaaggcgtctatggcggtggggacgaggccatctacccccccgaggtgccctatttttacccggaggagtcggcttcggcctttgtgtacccctgggtaccaccgcccatcccgtcgccccacaacccgtatgcccacgccatggatgacatcgccgagctggaggaaccagaggacgcgggcgtagagcgtcaggggacctccttccgcctgcccagcgccgccttcttcgagcagcaaggcatggataagcccgccaggtccaagctgtccctcatccgcaagttccgcctcttcccgcgaccccaggtgaagctgtttgggaaggagaagctggaggtgcccctgccaccctctctggacattcctctccccttgggggatgcggacgaagaagaggacgaggaggagctgcccccggtttccgctgtgccctacggccaccctttctggggcttcctcacgccgcgccagcgcaacctccagcgcgcgctgtcggccttcggcgcccaccggggcctgggcttcggccctgagtttggccgccccgtgcctcgccctgccacctcgcttgcgcggttcctcaagaagacgctgtcggagaagaagcccatcgcgcggctcaggggcagccagaaggcccgggcgggcggccctgctgtcagggaggcggcctacaaacgcttcggctacaagctggctggcatggaccccgagaagcccggcacgcccatcgtgctgaggagggcccagccacgcgctcgcagcagcaacgacgcgcgccgcccgcccgcgccacagcccgcgcccaggaccctctcccactggagcgcgctcctgtctccgcccgtgcccccgcggcccccaagctccgggcccccgcccgcgccgccgctctccccggcgctctcgggcctgccccggccggcctcgccctacggctccctccgccgccacccgccgccctgggccgccccagcgcacgtgccaccggcgccgcaggccagctggtgggccttcgtggagccccctgccgtgagcccggaggtgccccccgacctactagccttcccagggccccgaccctcgttcaggggctcccgccggagaggggcggctttcggcttccccggggcctctccacgggcgtcgcggaggcgagcttggtcaccgctggcctcgccccagccctcgctgaggagctcgccgggcctcggctactgctcacccttggcgcccccgtcgcctcagctgtccttgcgcacgggccccttccagccgcccttcctgcccccggcccgccggccccgctcgctgcaggagtccccagccccacgccgagccgctgggcgcctgggcccacccggctcgccgctgccgggctcacccaggccgccctcgccgcccctggggctctgccacagcccgcggcgcagctccctgaatctgccctcgcgcctcccgcacacgtggcggcgcctcagcgagccacccactcgggctgtgaagccgcaagtgcgcctgcccttccaccgaccgcccagggccggggcctggcgggcgcccctggaacaccgggagagcccgcgagaacccgaggactcagagacgccctggactgtgcccccactggcccccagctgggacgtggacatgcctcccacccaacgcccaccctccccctggccaggaggtgcaggcagccgccgaggcttttccaggccaccccctgtgccggaaaacccctttctccagctcctgggccctgtgccatcccccaccctccagcctgaggatccagctgctgatatgaccagggtcttcctgggcagacaccatgagccggggcctggacagctcaccaaatcagctggcccaacccctgagaagcctgaagaagaggccaccctgggggacccccagctgccagcagagaccaagcctccaaccccagcacctcccaaggatgtcactccccccaaggatatcactccccccaaggatgtcctcccagagcaaaagacattaaggcccagcctctcatacccactggctgcgtgtgaccagaccagggccacatggccaccatggcaccgctggggaacactgccccaagccgcagcccccttggcgcccatcagggccccagagcccctgcccaaggggggtgaacggcgccaggcagcccctgggcgttttgctgtggtcatgcctcgtgtgcagaagctgagctctttccagcgagttgggcctgcaaccctgaagcctcaagtccagcccattcaggaccccaagccaagagcctgtagtcttcgctggtcctgcctctggcttcgggcagatgcctatggaccctggccacgagtacacacccatccccagtcctgccacctgggccctggagctgcctgcctgtcccttaggggctcctgggaggaggtcggcccgccaagctggcggaacaagatgcactccatccgcaacctgccatccatgcggttccgtgagcagcacggggaggatggtgtggaggacatgacacagctggaagacctccaggaaaccactgtgctgtccaacctcaagattagatttgaacggaacctcatctacacatacattgggagcatcctggtgtcggtgaacccataccaaatgtttggaatctatgggccggagcaggtgcagcagtacaacggacgggccctgggagagaatcccccgcacctctttgctgttgcaaatctcgccttcgccaaaatgctcgatgccaaacagaaccagtgcataatcattagtggagagagcggctctggcaaaactgaggccaccaagctgattctgcgctacctggccgccatgaaccagaaacgggaggtcatgcagcagataaagatcctggaggcaacacccctcttggagtccttcggtaatgccaaaaccgtcaggaacgacaactccagccgctttgggaagtttgtggaaatctttctggaagggggcgtgatctctggtgccataacctcccagtacctgcttgagaaatccaggatcgtgtttcaggccaaaaacgagaggaattaccacatcttctacgagttgctggccgggttgcctgcccagctcaggcaggcctttagcctgcaagaggctgagacctactactatctgaaccagggtgggaactgtgagatagcaggaaagagcgatgcagatgactttcgccggctcctggctgccatggaggtgttgggcttcagcagtgaggaccaggacagcatcttccgcatcctggcctccatcctgcacctgggcaacgtctactttgagaagtatgagacggatgcacaggaggtggcctcagtggtgagtgcccgagagatccaggccgtggcagagctgctgcagatctcccctgagggcctgcagaaggccatcaccttcaaagtgaccgagacaatgcgagagaagatcttcacgcccctaactgtggagagcgctgtggatgccagggacgccatcgccaaggtcttgtatgcactgctgttcagctggctcatcaccagggtcaacgcgctggtgtccccaaggcaggacacactgtccatcgccatcctggacatctatggtttcgaggacctgagcttcaacagctttgagcagctgtgtattaactacgcaaacgagaaccttcagtaccttttcaacaagatcgtcttccaggaggagcaggaggagtacatccgtgagcagatagactggcaggagatcacctttgctgacaaccagccctgcatcaacctcatctcactgaagccttatggcatcctgcggatccttgacgaccagtgttgctttccccaggctacagaccacaccttcctacagaagtgccactaccatcatggcgccaacccgctctattccaaacccaagatgccgctgcctgagttcaccatcaagcactatgcaggcaaggtcacctaccaggtgcacaagttcctggacaagaaccacgaccaagtgcgccaggatgtgctggacctgttcgtacggagccggacacgggtggtggcacacctcttctccagccatgccccacaggctgcccctcagcgcctgggcaagagcagctccgtcactcggctctacaaggcgcacactgtggccgccaagttccagcagtcactcctggatctggtggaaaagatggagaggtgcaaccccttgttcatgcgttgcctgaagcccaaccacaagaaggagccaggtctctttgagccagatgtggtaatggcacaattacgctattcaggggtgctggagaccgtgaggatccgcaaggagggatttccagtgcgcctgcctttccaggggttcatcgacaggtactgctgtctagtggccctcaagcatgacctgccggctaatggggacatgtgtgtgtcagtgctgagtcgcctgtgcaaagtcatgccaaacatgtaccgtgttggggtcagcaagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggcaacgctatcagcagatgaggaggagtctggtgaagttccggtccctggtacacgcatacgtgagccgccgacgctatctcaagctgagggcagagtggaggtgccaggtggagggggcgctgctgtgggagcaggaggagctgagcaagcgggaggtagtcgctgtggggcacctggaggtaccggctgagctggctgggctcttgcaagcagtggcaggcctcgggctggcccaggtgcctcaggtggcccctgtgaggactcctcgactccaggctgagccccgtgtcacactgcccctggacatcaacaactatcctatggccaagtttgtccagtgccacttcaaggaacctgcctttgggatgctgacagtgcccctgaggacacccctcacgcagctgccagccgagcaccatgcagaagccgtgagcatcttcaagctgatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtgaccagttctcctgcccggtgcactcctggagtacgggggaagaggtggctggagacattctgaggcacagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaagagtcagacagtcttggagagcctgctgtgccccacaaggggctggactgctacctggatagcctctttgaccctgtgctgtcctacggggatgcggacctggagaagccaacagccattgcctaccgcatgaaagggggaggccagcccggtggaggcagcagtagtggtactgaagacacccccaggagacccccagagccaaagccaatcccaggcctggatgcctccacattggctctgcagcaagccttcatccacaaacaggccgtgctgctggcccgggagatgaccctgcaggccacggcactccagcagcagcccctgagtgctgccctgagatccttgcccgcagagaaacccccagcaccagaggcacagccgacgtctgtaggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccacttcaccctccccagagctggtccggtactctacgctcaactctgagcacttcccacagcccacacagcagatcaagaatattgtcaggcagtaccagcagccgttccggggaggccggcctgaggccctcaggaaggatggcgggaaagtgttcatgaagcggccagaccctcatgaggaggccctgatgatcctgaaagggcagatgacccacctggcagctgcacctggcacccaggtgtccagagaggccgtggccctggtgaagccggtgaccagtgcaccaaggccatccatggcacccacttcagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgaattgatggtgaagttccccctgaaggagatccagtcgacgcggacccagcggcccacggccaactccagctacccctatgtggagattgcgctgggggacgtggcggcccagcgcaccttgcagctgcagctggagcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctcaggatcaatgacccctgtaaggggccagagccttggaggacactaagaggaggcaggaggagcaactcaaatccccaagaacacaagaagacccatcctgaactgggatggaatggcagcatgcaaacttggatcagatagcaggaggaactttcaaaagtctggcccactgtgcagtggagcagaaggcaggaccatgaggcctcctgccatgtacccattgcagaccctgcccctaactcctgcctatgacacagaagccccacaccagttgcccagatgaactggcctctgcctttggtttactcagggtctgatgttggaatctgctccaactccacaccctagcccttacatgtcctcctaaggggcccctccttgtgctgccagtcagcctggatttctggtctttggttatttctgtgcaaacaaaaggtgtgcctggcagccatttctccatggagttgctaagtggccggaaaacaagcctgagggaggaggcaggagttggagttaccttaggcccctgattcactgcctatgaacagaccatcccccactccttgggtatccccaaccccagacccccatcacttgatgggccacacaagtttgagagtggtacaagggagaagtttgggaaaagccttcttggaaaatgggacattagcattgagttttgaaagatgagtaggagtttgctaagaatagatggaagacagcaggataaacattccagagaaaatcatgtttattccctgctgtatcttccagaacctaggaggatgcctaacagagagtaagcacttaaaaaatatttgtcatatgaatgaaaaaataaacgagtgaatgttgata

SEQ ID NO: 19228 - DNA, 1919 bp, Homo sapiens
atatatatattaattaaataaaaaaacgaggtgccttctcctgactccctgatccccgcgctctccagctctgccctcgcgatcgctggagccccctgaggaactcacgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgtgagtggcctcagcctggcactgccatcgccaccctctgttccctggtccccaaccccctccaagaggccaagacctccagccgccgaagcccagttccactgcttaccaccttcatgatctcaggcaagtctcttccctcctctgagccttgctttcctcatctggaaaatgaggataagagttgagccccacccatagggctgttgtgaaggtgagatgaggtaaaacatactctatgcactcaaatagtacatctgtgtgcttaggctgccataataaaagaccacagactgagtaactt

SEQ ID NO: 19229 - DNA, 1345 bp, Homo sapiens
atttagggggcggggccgggtgtgaagcaaggccagggggcagtcggacagtacccactgaagccccgcccctgcaggtgttttaccccaaggacagctacagccatcctgtgcagcttgacctcctgttccggcaggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgtgagtggcctcagcctggcactgccatcgccaccctctgttccctggtccccaaccccctccaagaggccaagacctccagccgccgaagcccagttccactgcttaccaccttcatgatctcaggcaagtctcttccctcctctgagccttgctttcctcatctggaaaatgaggataagagttgagccccacccatagggctgttgtgaaggtgagatgaggt

SEQ ID NO: 19230 - DNA, 998 bp, Homo sapiens
ctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgtaagagctggggaagtgttggatgggcgtggactgtcactgtcacctgcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctc

SEQ ID NO: 19231 - DNA, 1009 bp, Homo sapiens
atttagggggcggggccgggtgtgaagcaaggccagggggcagtcggacagtacccactgaagccccgcccctgcaggtgttttaccccaaggacagctacagccatcctgtgcagcttgacctcctgttccggcagcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggtgtgtgccccagaacctggaaccccatacggggcgcatcctagtttcacccactcgtggtgcagatgcacagtgagggtttcttggtgcccgaaagtggcctgggctggtcaggtctcctaaggtccagccgtggcctgtcagtatctgttggtggccagacagcccagccctctgctttgcctgaggggtctccgtgggcatttccatgtttgtggcctgaatctctctttatgtctccacatgacctgagagtccacaaaccctgctttgcctttttgcttcacttcccctttatggtcctgtgg

SEQ ID NO: 19232 - DNA, 7583 bp, Homo sapiens
tccatccctgaccgggccgaggctgctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagtccactccacagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggctgcgccagt

SEQ ID NO: 19233 - DNA, 7427 bp, Homo sapiens
tccatccctgaccgggccgaggctgctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagtccactccacagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggctgcgccagt

SEQ ID NO: 19234 - DNA, 5294 bp, Homo sapiens
gacagagctctgcttggccaacaaggagaacccaggatgggtaggctcttggtctgactgcccggaaaacaggtgatggaaggaccaaggactacaaagctagagggcagctcaaaggaaggcagtggcccatctaggagtcctcagcctcccaccagcccgatacccccagagacttcccagagagccaggagccctgcacccacactcgccatgaacggcccgggagctgccacagcagaaggcctaagcgaagaggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctg

SEQ ID NO: 19235 - DNA, 7597 bp, Homo sapiens
agctgcgccgcgctgcgctctgctccatccctgaccgggccgaggctgctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 19236 - DNA, 3329 bp, Homo sapiens
atcagagcggagtctccttgctctgggctgctccaggccaggccatgcgggcgaaaacagaagaacagattgcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctc

SEQ ID NO: 19237 - DNA, 7504 bp, Homo sapiens
ctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 19238 - DNA, 7522 bp, Homo sapiens
gcagggagtcacccggcgctgcggagctcagcacagccggccgggaggaggctccccctggagcacggggccaggccaggtgctggctacccctccggccgctgctacaacccttggcgaggggcagagcgcggggagagagccggggtcccggggctggaggaaacggccgctcagggagcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 19239 - DNA, 3329 bp, Homo sapiens; identical to SEQ ID NO: 19236

SEQ ID NO: 19240 - DNA, 1442 bp, Homo sapiens
attactgggatgcggccagtacaggcagctccttgagcatcactggtcctgggacccaccccagtgggcaggccccttgggcagggaatggggcaggggaggaggctgggctgggctggtggcttcatggcccctgagctagtcacctagctgctgagagatgccaatctcacgggcttgatttatccccatgacatttgtgctcctcagcagttctcagctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcct

SEQ ID NO: 19241 - DNA, 8565 bp, Homo sapiens
gggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccc

SEQ ID NO: 19242 - DNA, 8090 bp, Homo sapiens
cacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcagcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggca

SEQ ID NO: 19243 - DNA, 8051 bp, Homo sapiens
ggcagtaaggggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggtaaaagcaacaggctggggctattcttgggggaatgagagttcaccttgcagccttggggagagcaggtgccact

SEQ ID NO: 19244 - DNA, 6024 bp, Homo sapiens
tgtctctcctcataaagcttcaagttctgatccactttaaggtcgcatctctacgccagggtccttaactgggctaccatcaataacctgcagccatgagttccgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacacctactcaggcttgttctgtgtcactgtcaacccctacaagtggttgccagtgtataatgcagaggtggtgacagcctaccgaggcaaaaagcgccaggaggccccaccccacatcttctccatctctgacaatgcctatcagttcatgctgactgatcgggagaatcagtctatcttgatcaccggagaatctggcgcagggaagactgtgaacaccaagcgtgtcatccagtactttgcaacaattgcagttactggggagaagaagaaggaagaagttacttctggcaaaatgcaggggactctggaagatcaaatcatcagtgccaaccccctactggaggcctttggcaacgccaagaccgtgaggaatgacaactcctctcgctttggtaaattcatcaggatccacttcggtaccacagggaaactggcttctgctgatattgaaacatatcttctggagaagtctagagttactttccagctaaaggctgaaagaagctatcatattttttatcagatcatgtctaacaagaagccagatctaattgaaatgctcctgatcaccaccaacccatacgattatgccttcgtcagtcaaggggagatcacagtgcccagcattgatgaccaagaagagttgatggctacagatagtgccattgaaattctgggctttacttcagatgaaagagtgtccatctataagctcacaggggctgtgatgcattatgggaacatgaaattcaagcaaaagcagcgtgaggagcaagctgagccagatggcactgaagttgctgacaaggcagcctatctccaaaatctgaactctgcagatctgctcaaagccctctgctaccctagggtcaaggtcggcaatgagtatgtcaccaaaggtcaaactgtgcagcaggtgtacaatgcagtgggtgctctggccaaagctgtctacgataagatgttcttgtggatggtcacccgcatcaaccagcagctggacaccaagcagcccaggcagtacttcattggggtcttggacattgctggctttgagatctttgatttcaacagcctggagcagctgtgcatcaacttcaccaatgagaaactgcaacagtttttcaaccaccacatgttcgtgctggagcaggaggagtacaagaaggaaggcattgagtggacgttcattgactttgggatggacctggctgcctgcatcgagctcatcgagaagcctatgggcatcttctccatcctggaagaggagtgcatgttccccaaggcgacagacacctccttcaagaacaagctgtatgaacaacatcttggaaaatccaataacttccagaagcccaagcctgccaaaggcaagcctgaggcccacttctctttgattcactatgctggcaccgtggactacaacattgccggctggcttgacaagaacaaggaccccctgaatgagactgtggtggggctgtaccagaagtctgcaatgaagactctggctctcctctttgttggggcaacgggagcggaagcagaggctggcggtggaaagaaaggtggtaagaagaagggttcttctttccagactgtgtctgctctcttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggtgttaaatgcaagtgctatccctgaaggacaattcatcgatagcaagaaggcttcagagaagctcctggggtccattgacattgaccacacccagtataaatttggtcacaccaaggtctttttcaaagctggtcttctggggctcctagaggagatgcgagatgagaagctggcccagctgattacccgaacccaggccatgtgcagagggttcttggcaagagtggagtaccagaaaatggtggaaagaagagagtccatcttctgcatccagtacaatgtccgtgccttcatgaatgtgaagcactggccctggatgaagctgtatttcaagatcaaacccctcctcaaaagtgcagagacagagaaggagatggccaacatgaaggaagaatttgagaaaaccaaagaagagctggctaagaccgaggcaaaaaggaaagagctggaagaaaaaatggttactctgatgcaagaaaaaaatgacttgcaactccaggttcaagctgaagctgacagcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcgggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaaggatctttggaacaagaaaagaaaatccggatggatctagaaagagcaaagagaaaactagagggagacctaaaattggctcaagaatccacaatggatatagaaaatgacaaacaacaacttgatgaaaagcttaaaaagaaagagtttgaaatgagcggtctgcaaagcaagattgaagatgaacaagcccttggtatgcagctgcagaagaaaatcaaggagttacaagcccgcattgaggagctggaggaggaaatcgaggcagagcgggcctcccgggccaaagcagagaagcagcgctctgatctctcccgggagctggaggagatcagcgagaggctggaagaagccggtggggccacctcagcccagattgagatgaacaagaagcgggaggctgagttccagaaaatgcgcagggacctggaggaggccaccctacagcatgaagccacggcggccaccctgaggaagaagcatgcagatagtgtggccgagcttggggagcagattgacaacctgcagcgagtgaagcagaagctggagaaggagaagagtgagatgaagatggagatcgatgaccttgctagtaacatggagactgtctccaaagccaagggaaaccttgaaaagatgtgccgcgctctagaagatcaactgagtgaaattaagaccaaggaagaggagcagcagcggctgatcaatgacctcacagcacagagagcgcgcctgcaaacagaatcaggtgaatattcacgccagctagatgaaaaggacacactagtttcacagctctcgaggggcaaacaagcctttacacaacagattgaggaactgaaaaggcaacttgaagaggagataaaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatttgcaacaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctggatgatgctctccggagccaggaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaa

SEQ ID NO: 19245 - DNA, 3285 bp, Homo sapiens
gtctctcctcataaagcttcaagttctgatccactttaaggtcgcatctctacgccagggtccttaactgggctaccatcaataacctgcagccatgagttccgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacacctactcaggcttgttctgtgtcactgtcaacccctacaagtggttgccagtgtataatgcagaggtggtgacagcctaccgaggcaaaaagcgccaggaggccccaccccacatcttctccatctctgacaatgcctatcagttcatgctgactgatcgggagaatcagtctatcttgatcaccggagaatctggcgcagggaagactgtgaacaccaagcgtgtcatccagtactttgcaacaattgcagttactggggagaagaagaaggaagaagttacttctggcaaaatgcaggggactctggaagatcaaatcatcagtgccaaccccctactggaggcctttggcaacgccaagaccgtgaggaatgacaactcctctcgctttggtaaattcatcaggatccacttcggtaccacagggaaactggcttctgctgatattgaaacatatcttctggagaagtctagagttactttccagctaaaggctgaaagaagctatcatattttttatcagatcatgtctaacaagaagccagatctaattgaaatgctcctgatcaccaccaacccatacgattatgccttcgtcagtcaaggggagatcacagtgcccagcattgatgaccaagaagagttgatggctacagatagtgccattgaaattctgggctttacttcagatgaaagagtgtccatctataagctcacaggggctgtgatgcattatgggaacatgaaattcaagcaaaagcagcgtgaggagcaagctgagccagatggcactgaagttgctgacaaggcagcctatctccaaaatctgaactctgcagatctgctcaaagccctctgctaccctagggtcaaggtcggcaatgagtatgtcaccaaaggtcaaactgtgcagcaggtgtacaatgcagtgggtgctctggccaaagctgtctacgataagatgttcttgtggatggtcacccgcatcaaccagcagctggacaccaagcagcccagggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatttgcaacaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctggatgatgctctccggagccaggaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgcc

SEQ ID NO: 19246 - DNA, 6885 bp, Homo sapiens
gcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 19247 - DNA, 6924 bp, Homo sapiens
gcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 19248 - DNA, 6941 bp, Homo sapiens
gggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacggagggaccgtctttttggcgaggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggcccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 19249 - DNA, 6903 bp, Homo sapiens
gggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 19250 - DNA, 6942 bp, Homo sapiens
gggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 19251 - DNA, 5992 bp, Homo sapiens
aaattgctgtgaccgcagcatctctaggaagacgctttattcctgaaggacactgactgtcacttgggaaccaagaagccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccggatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactgatcgagacaaccagtctatcctcatcaccggagaatccggggctgggaagactgtgaacaccaagcgtgtcatccagtattttgcaacaattgcagttaccggggacaagaagaaggagacacagccaggcaaaatgcagggaaccctagaggatcagatcatccaggccaacccactgctggaggcctttggaaatgccaagactgtgaggaatgacaactcctcaagatttgggaagttcattcggattcattttggagccacaggaaagctggcatcggcagacatcgaaacttatctgttagaaaaatccagagtgacgtttcaattatccagtgagagaagctatcatattttctaccaaattatgtcaaacaagaagccagaactaattgacctgcttctgatctccaccaaccccttcgacttccccttcgtgagccaaggagaggtcacggtagccagtatcgatgacagtgaagaactgctggcgacagataatgccattgacatcctgggcttcagctcagaggagaaagtcgggatctacaaactgacgggagccgtgatgcattatgggaacatgaagttcaagcagaagcagcgtgaggagcaggcggagccagacggcaccgaagtggctgacaaagccggatacctgatgggactgaattctgcagaaatgctgaagggcctgtgctgtccaagggtgaaggttggcaatgaatatgtcactaaagggcaaaatgtccagcaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaacgagactgtggtggggctgtaccagaagtcttcgctgaagcttctctccttccttttttccaactatgctggtgcagagacaggcgactccggaggaagcaagaagggcgggaagaagaagggctcctctttccagaccgtgtcggccgtgttcagggaaaatttaaacaaattgatgactaacttaaggagcacccaccctcactttgtacgatgtctgattcccaatgagaccaagactcctggtgtgatggaccactacttggtcatgcaccagctgcgctgtaacggggtcctcgagggcatccggatttgcaggaagggattccccagccggatcctctatgctgacttcaagcagcggtaccggatcctcaatgccagtgctatccctgaagggcagttcattgacagcaaaaatgcctcagagaagctcctcaactccatcgatgtggaccgggagcagttcaggttcggcaacaccaaggtgtttttcaaagctgggctcctgggacttttggaggagatgagagatgagaagctggtgacgctgatgacaagcacgcaggcggtgtgcagggggtacctgatgcgggtggagttcaagaagatgatggagaggagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatcttgagggttccttagagcaggagaagaaactgcgggcggacttggaaagggcgaagaggaagctggaaggagatctgaaaatgtcccaggaatccattatggatctagaaaatgacaagcagcaaatagaagagaaattgaaaaagaaggagtttgaactcagtcagttacaagccaaaatagatgacgaacaagtccacagtttgcagtttcaaaagaagattaaagaactgcaagcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagattgacgacatggccagcaacatcgaggctctctccaagtcaaagagtaacatagaaagaacgtgccggacggtagaagatcaatttagtgaaatcaaagccaaggacgagcaacagacacagttgatccatgatctgaacatgcagaaagcaagactgcagacccaaaatggggagctgagccaccgagtggaagagaaggagtctctgatttcacagctgaccaaaagcaagcaggccctcacccagcagctggaggagcttaagaggcaaatggaagaagaaaccaaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaggaccaaatacgagacggacgccattcagcgcacagaggagctggaggaggccaagaaaaaactggcccagaggctccaggaagcagaggagaacacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttgcagagtggaagcaaaagctggacgaaagccaggctgagttggaagctgctcagaaggagtccaggtcactcagcactgaactcttcaagatgaggaatgcctatgaggaggtggtggaccagttagagacactgaggcgagagaacaaaaatctgcaagaagagatttccgacttaactgagcagattgcagaaactggcaagaatcttcaggaagcggaaaagaccaagaagctagtggagcaggaaaagtcagatctgcaggtcgccttagaagaagtggagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaagcatctgcgcacggtccagggccagctcaaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccagaacacaagcctgataaataccaagaaaaaactggaggctgacatagctcagtgccaggcagaggtggagaactcgatccaggagtccaggaacgcagaggagaaggccaagaaggccatcacggatgctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtgcgggagctggaaaatgagcttgatgtggaacagaagaggggagctgaagccctgaagggagcccacaagtacgaacgcaaagtcaaggagatgacttaccaggctgaggaggaccacaagaatatccttaggctccaggacctggtggacaagctgcaggccaaagtgaagtcttacaagaggcaggctgaggaggcggaggagcaggccaacacgcagctgtccagatgccggagagtccagcatgagctagaggaggccgcggagagggcggacatcgctgagtcccaggtcaacaagctgagggccaagagccgagacgtgggcagccagaagatggaagaatgaggctcacctgatgctcgttgccatgggacacctccgagagagtggagggaaaatgtgtgagaaataaattctcctaaatactcgg

SEQ ID NO: 19252 - DNA, 2221 bp, Homo sapiens
acttatttgggcaaatgctgtctcatatgctatacaaaaaagagaatgccattgacatcctgggcttcagctcagaggagaaagtcgggatctacaaactgacgggagccgtgatgcattatgggaacatgaagttcaagcagaagcagcgtgaggagcaggcggagccagacggcaccgaagtggctgacaaagccggatacctgatgggactgaattctgcagaaatgctgaagggcctgtgctgtccaagggtgaaggttggcaatgaatatgtcactaaagggcaaaatgtccagcaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaacgagactgtggtggggctgtaccagaagtcttcgctgaagcttctctccttccttttttccaactatgctggtgcagagacaggcgactccggaggaagcaagaagggcgggaagaagaagggctcctctttccagaccgtgtcggccgtgttcagggaaaatttaaacaaattgatgactaacttaaggagcacccaccctcactttgtacgatgtctgattcccaatgagaccaagactcctggtgtgatggaccactacttggtcatgcaccagctgcgctgtaacggggtcctcgagggcatccggatttgcaggaagggattccccagccggatcctctatgctgacttcaagcagcggtaccggatcctcaatgccagtgctatccctgaagggcagttcattgacagcaaaaatgcctcagagaagctcctcaactccatcgatgtggaccgggagcagttcaggttcggcaacaccaaggtgtttttcaaagctgggctcctgggacttttggaggagatgagagatgagaagctggtgacgctgatgacaagcacgcaggcggtgtgcagggggtacctgatgcgggtggagttcaagaagatgatggagaggagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatgaaggagtttgaactcagtcagttacaagccaaaatagatgacgaacaagtccacagtttgcagtttcaaaagaagattaaagaactgcaagtaaaagcatcaaaaccttcccaatcatgacaatccctttgcaagagcgcccctcctcactccttcccccttgtttctttagctgcttctttccttcctcctgctaaagctagagaagatgtcctgt

SEQ ID NO: 19253 - DNA, 6873 bp, Homo sapiens
gcagaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgaacatgggggcttccagcagttctctttccttggctccttcccaccgtcgcccccaggatctgcagagaggtgcagctctgctatttctccgccaggggtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaccatc

SEQ ID NO: 19254 - DNA, 4484 bp, Homo sapiens
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaagagcggaagctgctggaagatcgtctggccgagttctcatcccaggcagctgaggaggaggagaaggtcaagagcctcaataagctacggctcaaatatgaggccacaatcgcagacatggagggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccctgtccccagatgcactaacagatggggcccagcccccttcctccctggaccccacgggcccctgtcccaggaaccccgccctctga

SEQ ID NO: 19255 - DNA, 6139 bp, Homo sapiens
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaagagcggaagctgctggaagatcgtctggccgagttctcatcccaggcagctgaggaggaggagaaggtcaagagcctcaataagctacggctcaaatatgaggccacaatcgcagacatggagggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 19256 - DNA, 6886 bp, Homo sapiens
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgaacatgggggcttccagcagttctctttccttggctccttcccaccgtcgcccccaggatctgcagagaggtgcagctctgctatttctccgccaggggtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 19257 - DNA, 6811 bp, Homo sapiens
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 19258 - DNA, 6910 bp, Homo sapiens
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgtaagcaaccccgccttgggctggggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgaacatgggggcttccagcagttctctttccttggctccttcccaccgtcgcccccaggatctgcagagaggtgcagctctgctatttctccgccaggggtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 19259 - DNA, 7074 bp, Homo sapiens
catttctacttcatatgatcattttaattgtatttacctcatcttaccaaaaagatcatggttgaatcttgcctactcacgtttagggcctttttttggtggattgctttaataaagatggatctgtcagaccttggagaagccgcagccttcctcagaagaagtgaagctgagctgcttctactacaggccacagccttggatgggaagaagaaatgctggattcctgatggtgagaatgcttatatcgaggctgaggtaaaagggagtgaagatgatggaacagtaattgttgagacagcagatggagagagtctgagcataaaggaggacaaaatccagcagatgaatcctccagagtttgaaatgattgaagacatggcaatgctgactcacctcaatgaggcatccgtgctgcataccctgaagcggcgctatggccagtggatgatctatacatattcaggtctcttctgtgtgaccataaacccttacaaatggcttcccgtgtatcagaaagaagtcatggccgcctacaaagggaagaggcgatcagaggctccccctcacatctttgctgttgccaataacgcctttcaggacatgcttcacaatcgagaaaatcagtctatactcttcacaggagaatctggtgctggaaagactgtgaacagcaaacatattatccagtattttgccaccatagcagccatgattgaatccaggaaaaagcagggggcgttagaagatcaaatcatgcaagcgaatactatcttggaagcatttggaaatgctaaaaccctgagaaatgacaactcctctcgttttggcaaattcatcaggatgcactttggtgccagaggcatgctgtcatctgtggacattgatatctatttgcttgaaaagtccagggtgattttccagcaggctggagagaggaactaccacatattctatcaaattctatctggacaaaaagagcttcatgacctgctcctggtatctgcaaatccctcagacttccacttttgctcctgtggagcagttactgtggagagcttggatgatgctgaagaattgctggccacagaacaagccatggacatcttgggctttcttcctgatgagaagtatggatgctataaactcactggagccatcatgcactttggaaatatgaaatttaaacagaaacctagagaagagcaactggaagcagatggcacagaaaatgctgacaaagctgctttcctcatgggcattaactcctctgagttggtaaagtgcttgatccatcctagaatcaaagttggtaacgaatatgttaccagaggtcaaactatagaacaggtaacctgtgctgtcggtgccctgtccaagtcaatgtatgaaaggatgtttaagtggctagtggcacggatcaacagggccctggatgccaagctgtcaaggcagttcttcattggcattcttgacatcactggttttgaaatccttgagtataatagccttgagcaactttgcattaattttaccaatgaaaaattacaacaattcttcaattggcacatgtttgttctggagcaagaggaatataagaaagaaagcattgaatgggtgtctattggctttggtctggatttgcaagcttgcatagatctcattgagaagccaatgggcatcctttccatccttgaagaagagtgtatgtttcctaaggctacagacctgactttcaagaccaaactctttgacaaccattttggaaagtcggttcatctccagaagcccaagcctgataagaagaaatttgaagctcattttgaacttgtccattatgcaggagtggtaccttataatatcagtggttggctggaaaagaacaaagacctccttaatgaaacagtggtagctgtatttcagaagtcttccaacagactcctggcgagcctttttgaaaattacatgagtactgacagtgctataccatttggggagaagaaacgaaagaaaggagcttcattccaaacggttgcatctctgcataaagaaaacctgaataaattgatgactaatctgaaatcaacagcacctcattttgtgagatgcataaatcccaatgtgaacaaaataccaggtatactggacccttacttggttctacagcagttgcgctgtaatggtgtcttggaagggactaggatatgccgtgaaggttttccaaaccgactgcagtatgctgattttaaacaaaggtactgcattctgaatccaaggacctttccaaagagcaagtttgtgagcagcagaaaagcagctgaagaattacttggctccttggagatagaccatacccagtaccgatttggaatcactaaggtgttttttaaagctgggtttctgggccaactggaagcaataagagatgagagactatctaaagtcttcacattgttccaagccagagcacagggcaaactgatgcgaatcaaattccagaagattctggaagaaagggatgcacttattttgatccaatggaacataagagctttcatggctgtgaagaactggccctggatgaggctcttcttcaagatcaagcctcttgttaaatcttcagaagtaggagaagaagtagctggactgaaggaagagtgtgcacaattacagaaagccttggagaaatcagagtttcagagggaggaactgaaagcaaagcaagtatccctcactcaggaaaaaaatgacctgattcttcagcttcaggctgagcaagagacactggcaaatgttgaagagcagtgcgagtggctgattaaatccaagatccagctggaggccagagtaaaggagctgtcggagagggtggaggaagaagaggagataaattctgagctgactgccagggggcggaaactcgaagatgaatgttttgagttgaagaaagaaatcgatgacctggaaacaatgttggtgaagtcagagaaggagaagcgtactacagagcacaaggtcaagaacttgactgaggaagtagagtttctaaatgaggatatcagcaaacttaacagagcagccaaggttgtgcaggaggcccatcagcagaccctggatgacctgcacatggaggaggagaagctcagcagcctgagcaaagcaaatctgaagctggaacagcaagttgatgagcttgagggtgcccttgagcaggagagaaaagcgagaatgaactgtgaaagggaactgcacaaactggagggcaatttaaagctgaatcgggaaagtatggagaacctggaaagcagccagcgacacctggcagaagagctgaggaaaaaagaattagaattgagtcagatgaattcaaaagtggagaatgagaaaggcctggtagctcagcttcagaagacggttaaagagcttcagactcaaataaaggatttgaaagagaaactagaagctgaaaggaccactcgagccaagatggaaagggagagagctgacctcacccaagacctggctgacttgaatgagaggctggaggaggtaggaggatccagtttggctcagctggaaataactaagaaacaggaaaccaaattccagaagctgcaccgagacatggaagaggccactctgcactttgagacaacttctgcatctttgaagaagagacatgcagacagcctggctgagctcgagggccaggtagaaaatctacagcaggtcaagcagaaactggaaaaagacaagagtgacttgcagctagaagtagatgacctcctgacccgtgttgagcagatgacaagagctaaggcaaatgctgagaaactctgtactctatatgaagagcgcttgcatgaagcaactgcaaagctagataaggtgactcagttggcaaatgacctggcagcacaaaagacaaagctgtggagtgagagtggcgagttcctacggaggcttgaagagaaggaggctctgataaaccaactttccagggaaaagagcaacttcactcggcagattgaagacctgagagggcagctggaaaaggagaccaaatcccagagtgccctggcccatgccctgcagaaggctcagcgtgactgtgaccttctacgagagcagtatgaggaagaacaagaggtcaaggctgagctgcaccggaccttatccaaagtcaatgctgaaatggtgcaatggagaatgaagtatgaaaacaatgtcatccagagaacagaagacttggaggatgccaagaaggaactggcaattagattgcaggaggcagccgaagccatgggggtggccaatgccagaaatgcctccttggagagagccaggcaccagctgcagctggagctcggggacgccctgtctgacctcgggaaggtccgctctgcagcagccaggctggaccagaagcagctgcagtctggcaaggcccttgccgactggaagcagaagcacgaggagtcccaggcgttgctggatgcctctcagaaggaagttcaggctctcagtacagagctcctcaagctcaagaacacctatgaggagagcatcgtgggccaggagacactcaggagggagaacaagaacctccaagaagagatttctaatctgacaaaccaggttagagaagggaccaagaacttaactgaaatggaaaaggtcaagaaactaattgaagaagagaagacagaagtccaggtgacactggaagaaacagagggagccctggaacgtaatgaaagcaagattcttcatttccagcttgaactcttggaagctaaagcagaacttgaaagaaagctttcagagaaagatgaagaaatagaaaattttaggaggaagcagcagtgtaccattgactccctgcagtctagtctggattctgaagctaagagcagaattgaggttacccggctgaagaagaagatggaagaggacctcaatgagatggaactccagcttagctgtgccaaccggcaggtgtcagaagcaaccaaatccctgggccagcttcagattcaaatcaaggaccttcaaatgcagctggatgacagcacacaactgaacagtgatctgaaggagcaggtggctgtggctgagcggcgcaactctcttcttcagtctgaactagaggatctaaggtccctgcaagagcagacagagcgtggccgcaggctgtcagaagaagagctcctggaagcaacagaaagaatcaatcttttctatacccagaacacaagcctcctcagccagaagaagaaactggaggctgatgttgcccggatgcagaaagaagctgaagaggtggtgcaggagtgtcaaaatgcagaagagaaggccaagaaggcagccattgaggcagcaaacttgtcagaagaactgaagaagaagcaagacaccattgcccacttggaaaggacaagagaaaatatggagcagacaattacagacttacagaaaaggctggctgaagctgaacagatggccctgatggggagtagaaagcaaatccagaaactagaatccagggttcgtgaactggaaggtgaactggagggtgaaatccgtcgcagtgcagaggcccagaggggagcccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttttcaattctgatgtttaaaaaatgaataaatacttgatcctttgtccatatttcctcttaatgggtaggactcatagaagatgtccttagaccagtcacgcttcatggggactagggcatgttggtgaatggtttttactaaagttaggcaactttggcttgattcacccctaaatctatgaatgtatattgtgagccagcagtggtagaatggaagtcataagatctcctcagcattgtgatataaatatagctatagttaggcaatttgaacatgtaggcaaaactctcctaatcaacacacatgtaggctatatgctggtacatgctttaaacatggaggtaaccccacacgagacattcagtgacaggtaatatgctggatttgtgcagtaccgatttggctcagctggaggaacatgtcccggaattcctctctctcatggttctggattggagtaggtcataaagaaatttgcattaatttgatcagcagctattttatactcataaggtcagtgtacagacccaagcatggtgacagcttgaaaatatgactccaggccaaaaaggggagctagaagagaccagagacagctccctggacccagagctcttccagctcctgccagcctcctccttcagctttgcaaagtactggccaggtgtgtgtgcagctccatggcaaccagcatcagcttttcctgagatcacacacagcattgcagtggaggccgtgagacagacatgggttctgtttgttcttatggacttcccttcatccttgctgcattcacagtcgacctacagtgacttcaggcccagaaccagatgcagagggaacagcctggcctagacttctccaccagcacccacaattgtgtaaggctgaagctctataataaatctttattctgtc

SEQ ID NO: 19260 - DNA, 6339 bp, Homo sapiens
aaaaagaagttccgagggaagccaggtatcctggctgcccagccactgcctttatccaccagcttgactctttcagatcatcttctcaaattatccataggagatttatccacatactcaataagaaaaatatttctaattatatccaaccattcttaatatgaatgagaattatgcggggacgctagattgccaagaggtattttgccaaacaattccttttgacttaagaaagaagaggcagctgcattgtttccatagctatccatataaaagagcccttggaatgaggctgactcgtcctgctttaaaaagctccaagaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcagagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaggcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaac

SEQ ID NO: 19261 - DNA, 6078 bp, Homo sapiens
aggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcagagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaggcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgc

SEQ ID NO: 19262 - DNA, 675 bp, Homo sapiens
aggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtg

SEQ ID NO: 19263 - DNA, 671 bp, Homo sapiens
aggacgggcctttcaagagggacactggtcacaccgcccagtgtcagcagcagctgctagttctggtactgctccttctggaactgcacgttttacctctatgaattttgttacttctgtttacaatagcaagccatgccataaatgggattttttccccctctttttggtcaactaatcaagtgcttttcccttttcttttatagaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtg

SEQ ID NO: 19264 - DNA, 2322 bp, Homo sapiens
aactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaata

SEQ ID NO: 19265 - DNA, 6016 bp, Homo sapiens
gtctgggatctcctggctgttgctgtcttctgctctcatcctgcaggtgggactctcagctgacaccatgagtagtgacactgaaatggaagtgttcggcatagctgctcctttcctccggaagtcagaaaaggagaggatcgaggctcagaaccagccctttgatgccaagacgtattgcttcgtggtggactcaaaggaagaatatgccaaggggaaaatcaagagttctcaggatgggaaggtcactgtggaaactgaggacaacaggaccctggtggtcaaaccagaggatgtgtacgccatgaacccccccaagttcgacaggatcgaagacatggccatgctgacgcacctgaatgagccagccgtgctgtacaacctgaaggaccgttacacatcttggatgatctatacctactcaggcctcttctgtgtcactgtcaacccctacaagtggctgccggtgtacaaccccgaggtggtggaaggctaccgaggcaaaaagcgccaggaggccccaccccacatcttctccatctctgacaacgcctatcagttcatgctgactgatcgtgaaaaccagtccattctgatcaccggagaatccggggcaggaaagactgtgaacaccaaacgggtcatccagtactttgcaacaattgcagctactggggacctggccaagaagaaggactccaaaatgaaggggactctggaagatcaaatcatcagtgccaatcccctgctggaggcctttgggaacgccaagactgtgaggaatgacaactcctcccgttttggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatgcagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggccgaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggcgattttaaacaaagataccgagtgctgaatgccagtgcaatccctgagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcagagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacagagaacaaggttaaaaaccttactgaggaactctctgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgagtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcggagttcctgaagctgcgcagggacctggaggaggccacactgcagcacgaagccatggtggccgcgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagatcgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccggggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaatctgg

SEQ ID NO: 19266 - DNA, 6016 bp, Homo sapiens
atccttcctcaaaattcttgaagtagttgtctgctttgagcctgccaccttcttcatctgataatacaagaggtatacctagtccagtactgccatcaataacctgcagccatgagttctgactctgagatggccatttttggggaggctgctcctttcctccgaaagtctgaaaaggagcgaattgaagctcagaacaagccttttgatgccaagacatcagtctttgtggtggaccctaaggagtcctacgtgaaagcaatagtgcagagcagggaaggggggaaggtgacagccaagaccgaagctggagctactgtaactgtgaaagaagaccaagtcttctccatgaaccctcccaaatatgacaagatcgaggacatggccatgatgactcacctgcatgagcctgctgtgctgtataacctcaaagagcgttacgcagcctggatgatctacacctactcgggcctcttctgtgtcaccgtcaacccctacaagtggctgccggtgtacaaccctgaggtggtgacagcctaccgaggcaaaaagcgccaggaggccccaccccatatcttctccatctctgacaatgcctatcagttcatgctaactgatcgtgaaaaccagtcaatcttgattactggagaatctggtgcagggaagactgtgaacacgaagcgtgtcatccagtactttgcaacaattgcagttactggagagaagaaaaaagaggaacctgcctctggcaaaatgcaggggacccttgaagatcaaatcatcagtgctaaccccctactggaagccttcggcaatgccaagaccgtgaggaatgacaactcctctcgctttggtaaattcatcaggatccattttggtgccacaggcaaactggcttctgcagatattgaaacatatctgctagagaagtcccgagttacttttcagctaaaggctgaaagaagctaccacatattttatcaaatcctgtccaataagaaaccagagctcattgaaatgcttctgatcaccaccaacccatatgacttcgcatttgtcagccaaggggaaattactgtgcccagcattgatgaccaggaagagctgatggccacagatagtgctgtggacatcctgggtttcactgctgatgaaaaggtggccatttacaagctcactggagccgtgatgcattatgggaacatgaaattcaagcaaaagcaaagggaagagcaggcagagccagatggcacggaagttgctgacaaagctgcttatctgacaagtctgaactctgctgacctgctcaaatctctctgctatcccagagtcaaggtcggcaatgagttcgtaaccaaaggccagactgtgcagcaggtgtacaatgcagtgggtgctctggccaaagccatctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaacgagaaactgcaacagtttttcaaccaccacatgttcgtgctggagcaggaagagtacaagaaggaaggcatcgagtgggagttcattgacttcgggatggacctggctgcctgcatcgagctcatcgagaagcctatgggcatcttctccatcctagaagaggagtgcatgttccccaaggcaacagacacctccttcaagaacaagctgtatgaacaacatcttggaaaatccaacaacttccagaagcccaagcctgccaaaggcaagcctgaggctcacttctcactggtgcactatgccggcaccgtggactacaacatcgccggctggctggacaaaaacaaggaccccctgaatgagactgtggtggggctgtaccagaagtctgcaatgaagactctggctttcctcttctctggggcacaaactgctgaagcagagggtggtggtggaaagaaaggtggcaaaaagaagggttcttctttccagacagtgtcagctcttttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggttctaaatgcgagtgctatcccagagggtcagttcattgacagcaagaaggcttctgagaaacttctagggtctattgaaattgaccacacccagtacaaattcggtcataccaaggttttcttcaaagctggcctgctgggaactctagaggaaatgcgagatgaaaagctagctcaactcatcacgcgcactcaagccatatgcagagggttcctgatgagagtggagttcagaaagatgatggagaggagagagtccatcttctgcattcagtacaacatccgtgctttcatgaatgtgaagcactggccctggatgaagctgtatttcaagatcaagcccctcctcaagagtgcagagacagagaaggagatggccaacatgaaggaagaatttgagaaaaccaaagaagagctggctaagacagaggcaaaaaggaaagaactagaagaaaagatggtgacgctaatgcaagagaaaaatgacttacaactccaagttcaagctgaagcagatgccttggctgatgcagaggaaagatgtgatcagttgattaaaaccaaaatccaacttgaggccaaaatcaaagaggtaactgaaagagctgaggatgaggaagagatcaatgctgagctgacagccaagaagaggaaactggaggatgaatgttcagagctcaagaaagacattgatgaccttgagctgacactggccaaggttgagaaggagaaacatgccacagagaacaaggtgaaaaacctcacagaagagatggcaggtctggatgaaaccattgctaagctgaccaaggagaagaaggctctccaggaggcccaccagcagaccctggatgacctgcagatggaggaggacaaagtcaacaccctgaccaaagctaaaaccaagctagaacagcaagtggacgatcttgaaggatctctggaacaagaaaagaaactttgcatggacttagaaagagccaagagaaaactggagggtgacctaaaattggcccaagaatccacaatggatacagaaaatgacaaacagcaacttaatgagaaactcaaaaagaaagagtttgaaatgagcaatctgcaaggcaagattgaagatgaacaagcccttgcaatacagctacaaaagaagatcaaagaattacaggcccgcattgaggagctggaggaggaaatcgaggcagagcgggcctcccgggccaaagcagagaagcagcgctctgacctctcccgggagctggaggagatcagtgagaggctggaagaagccggtggggccacttcagcccagattgagatgaacaagaagcgggaggctgagttccagaaaatgcgcagggacctggaagagtccaccctgcagcacgaagccacggcagctgctcttcggaagaagcacgcagatagtgtggctgagcttggggagcagattgacagccttcagcgggtcaagcagaagctggagaaggaaaagagtgagctgaagatggagatcaatgaccttgctagtaacatggagactgtctccaaagccaaggcaaactttgagaaaatgtgccgcaccctagaggaccagcttagtgaaataaaaacaaaggaagaagagcaacaacgcttaataaatgagttgtcagcccagaaggcacgtttacacacagaatcaggtgagttttcacgacagctagatgaaaaagatgctatggtttctcagctatcccgaggcaaacaagcatttacacaacagattgaagaattaaagaggcagctagaagaggagactaaggccaagagcactctggcccatgccctgcagtcagcccgccatgactgtgacctgctgcgggaacagtatgaggaggagcaggaagccaaggctgagctgcagaggggaatgtccaaggccaacagtgaggttgcccagtggaggaccaagtacgagacggacgccatccagcgcacagaggagctggaggaggccaagaagaagctagcccagcgtctgcaggatgcagaagaacatgtagaagctgtgaattccaaatgtgcttctcttgaaaagacaaagcagaggctacagaatgaagtagaggacctcatgattgatgtggaacgatctaatgctgcctgcatagctctcgataagaagcaaagaaactttgacaaggttctggcagaatggaaacagaagtatgaggaaactcaggctgaacttgaggcctcccagaaggagtcgcgttctctcagcactgagctgttcaaggtgaagaatgcctacgaggaatccctggatcatcttgaaactctaaagcgagagaataagaacttacaacaggagatttctgacctgacagagcaaattgcagagggtggaaagcatatccatgaactggagaaagtaaagaaacaacttgatcatgagaagagtgaactacagacttccctagaggaagcagaggcatctcttgagcatgaagaaggcaaaattcttcgcattcaacttgagctaaatcaggtgaaatctgagattgaccgaaaaattgctgaaaaagatgaagaactcgatcagctaaagaggaaccatctcagagttgtggagtcaatgcagagtacactggatgctgagatcaggagcagaaatgatgctctgaggatcaagaagaagatggagggagatcttaatgaaatggaaatccagctgaaccatgccaaccgccaggctgctgaggcactaaggaatcttagaaacacacaaggaatactgaaggacactcagctacatttggatgatgccatcagaggccaagatgaccttaaggaacaactggcaatggttgagcgcagagctaacctgatgcaggctgaagttgaagagctcagggcatccctggaacggactgagagaggcaggaaaatggcagagcaagagcttctggatgccagtgaacgtgtgcaacttctgcacactcagaacaccagcctgatcaacaccaagaagaagctggaaacagacatttcccaaatccagggagagatggaggacatcgtccaggaagcccgcaatgcagaggagaaggccaagaaggccatcactgatgctgccatgatggctgaggagctgaagaaggaacaggacaccagcgcccacctggagcggatgaagaagaacatggagcagaccgtgaaggatctgcagctccgtctggatgaggctgagcagctggcgctgaagggtgggaagaagcagatccagaaactggaggccagggtgagagagcttgaaagtgaggtggaaagtgaacagaagcacaatgttgaggctgtcaagggtcttcgcaaacatgagagaagagtgaaggaactcacttaccagactgaggaggaccgcaagaatattctcaggctgcaggacttggtggacaaattgcaaaccaaagtcaaagcttacaagagacaagctgaagaggctgaggaacaatccaatgtcaaccttgccaagttccgcaagctccagcacgagctggaggaggccaaggaacgggctgacattgctgagtcccaagtcaacaagctgagagtgaagagtcgggaggttcacacaaaagtcataagtgaagagtaattcattctaatgaaagaaaatgtgaccaaagaaatgcacgaaatgtgaagttctttgtcactgtcctgtatatcaaggaaataaa

SEQ ID NO: 19267 - DNA, 5871 bp, Homo sapiens
cgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcact

SEQ ID NO: 19268 - DNA, 5941 bp, Homo sapiens
agatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgcc

SEQ ID NO: 19269 - DNA, 6087 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagaccgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccgaga

SEQ ID NO: 19270 - DNA, 6042 bp, Homo sapiens
cacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagaccgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgctctgctcggcctcccctcctccaacttcctcctcccacctcccctttctgctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccg

SEQ ID NO: 19271 - DNA, 6019 bp, Homo sapiens
gtggaacacttctgaacctgcatttttatctggaactccagaggcagaatcctttgctaaataaatcgcagccatgagtgcgagctcagacgctgagatggctgtttttggcgaagctgctccctaccttcgaaaatcagaaaaggagcggattgaggcccaaaacaagccgtttgatgctaaaacatctgtctttgtggcggagcccaaggaatcctatgtgaagagcactatacaaagcaaagaaggagggaaagtaaccgtaaagactgaaggtggagcaactctaactgtcagggaagaccaagtcttccctatgaaccctccgaaatatgacaaaattgaggacatggccatgatgactcatctacacgagcctggagtgctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgttgactgatcgagagaatcagtccatcctgatcaccggagaatctggtgccggaaagactgtgaacaccaagcgtgtcatccaatactttgcaacaattgcagttactggagagaagaagaaggatgaatctggcaaaatgcaggggactctggaagatcaaatcatcagcgccaatcccctactggaggcctttggcaatgccaaaactgtgaggaatgacaactcctctcgctttggtaaattcattagaatccactttggtactacagggaagctggcatctgctgatatagaaacatatcttttagaaaagtccagagttactttccagctaaaggcggaaagaagctaccatattttttatcagatcacttccaataagaagccagatctaattgaaatgctcctgatcaccaccaacccatatgactatgccttcgtcagtcagggggagatcacagttcccagtattgatgaccaagaagagttgatggccactgatagtgccattgacatcctgggcttcactcctgaagagaaagtgtccatctataaactcacaggggctgtgatgcattatgggaacatgaaattcaagcaaaagcagcgtgaggagcaagctgagccagatggcacagaagtcgctgacaaggcagcctatctccagagtctgaactctgcagacctactcaaagccctctgctaccctagggtcaaggttggcaatgagtatgtcaccaaaggccagactgtgcagcaggtgtacaatgcggtgggtgctctggccaaagccgtctacgagaagatgttcctgtggatggtcacccgcatcaaccagcagctggacaccaagcagcccaggcagtacttcatcggggtcttggacattgctggctttgaaatctttgattttaacagcctggagcagctgtgcatcaacttcaccaacgagaaactgcaacagtttttcaaccaccacatgtttgtgctagagcaggaggagtacaagaaggaaggcatcgagtggacgttcattgactttgggatggacctggctgcctgcattgagctcattgagaagccactgggcatcttctccatcctggaagaggagtgcatgttccctaaggcaacggacacctccttcaagaacaagctgtatgaccagcacctgggcaagtctgccaacttccagaagcccaaggtggtcaaaggcaaggctgaggcccacttctctctgattcactatgctggcactgtggactacaacattactggctggctggacaaaaataaggaccccctgaatgatactgtggttgggctgtaccagaagtctgcaatgaagactctagccagtctcttttccacgtatgctagtgctgaagcagatagcagcgcgaagaaaggtgctaagaaaaagggctcttctttccagactgtgtctgcccttttcagggaaaatttaaataaattgatgacgaatctgaggagcacacaccctcacttcgtacggtgtatcattcccaatgaaaccaaaactcctggggcaatggaacatgaacttgtgttgcaccagctgaggtgtaatggtgtgctggaaggcatccgcatctgtaggaaaggattcccaagcagaatcttatatggtgatttcaaacaaagatacaaggttttaaatgcaagtgctattccagagggacagttcattgacagcaagaaggcttctgagaaacttcttgcatctattgatattgatcatactcaatataaatttggacataccaaggttttcttcaaagctggacttctgggtcttctggaagaaatgagagatgaaaaattagcccaaattataacaagaacacaagctgtctgtaggggattcctaatgagggtagaatatcagaagatgttgcaaaggagagaagcacttttctgcatccagtataatgtccgtgccttcatgaacgtcaagcactggccctggatgaaactctttttcaagattaagcccctcctcaagagtgcagagaccgagaaagagatggccaccatgaaggaagaattccagaaaaccaaagatgaactcgccaagtcagaggcaaaacggaaggagctagaggaaaaaatggtcactctcttaaaagagaaaaatgacctgcaactccaggttcaatctgaagcagatagcttggctgatgcagaggaaaggtgtgagcaactgattaaaaacaaaatccaacttgaggccaaaatcaaagaggtgactgaaagagctgaggaggaggaagagatcaatgctgagctgacagccaagaagagaaaactggaggatgaatgttcagaactcaagaaagacattgatgaccttgagctgacactggccaaggttgagaaggagaaacatgccacggagaacaaggtgaaaaatcttacagaagagatggcaggcctggatgaaaccattgcaaaactgtccaaggagaagaaggctctccaagagacccaccagcagaccctggatgacctgcaggcagaggaggacaaagtcaacatcctgaccaaagctaaaaccaagctagaacagcaagtggatgatcttgaagggtctctggaacaagaaaagaagcttcgaatggatctagaaagagcaaagcggaaactggagggtgacctcaaattggcccaagaatccacaatggatatggaaaatgacaaacagcaacttgatgaaaagcttgaaaagaaagaatttgaaatcagcaatttgataagcaaaattgaagatgagcaagctgtagaaattcaactacagaagaagatcaaagagttgcaggcccgcattgaggagctgggggaagaaatcgaggcagagagggcgtcccgagccaaagcggagaagcagcgctctgacctctcccgggaactggaggagatcagcgagaggctggaagaagccggtggggcaacttctgctcaggtggaattgaacaagaagcgggaggctgagtttcagaaactgcgcagggacctggaggaggccaccctgcagcatgaagctatggtggctgctcttcggaagaagcacgcagacagtatggctgagcttggggagcagattgacaacttgcagcgggtcaaacagaagctggagaaggagaagagtgagctgaagatggagactgatgacctcagcagtaacgcagaggccatttccaaagccaagggaaaccttgaaaagatgtgccgctctctagaagatcaagtgagtgagcttaagaccaaggaagaggagcagcagcggctgatcaatgacctcacagcacagagagcgcgcctgcagacagaagcgggtgaatattctcgacaattagatgagaaagatgctttagtctctcagctttcaaggagcaagcaagcatctactcagcagattgaagagctgaaacatcaactagaggaagaaactaaagccaagaacgccctggcacacgccctgcagtcctcccgccatgactgcgacctgctgcgggaacagtatgaggaagagcaggaaggcaaagctgagctgcagagggcgctgtccaaggccaacagtgaggttgcccagtggagaaccaaatacgagacggatgccatccagcgcacagaggagctggaggaggccaagaaaaagttggcccagcgcctgcaagaagctgaggaacatgtagaagctgtgaacgccaaatgtgcttcccttgagaagacgaagcagcggctccagaatgaagttgaagacctcatgcttgatgtggaaaggtctaatgcagcctgtgcagcccttgataagaagcaaaggaactttgacaaggtcctatcagaatggaagcagaagtatgaggaaactcaggctgaacttgaggcctcccagaaggagtcacgttctcttagcactgagctgttcaaggtgaagaatgtctatgaggaatccctggatcaactcgaaacgctaagaagagaaaataagaacttgcaacaggagatttctgacctcactgagcagattgcagagggaggaaagcaaattcatgaattggagaaaataaagaagcaagtagaacaagagaaatgtgaaattcaggctgctttagaggaagcagaggcatctcttgaacatgaagaaggaaagattctgcgtatccagcttgagttaaaccaagtcaagtctgaagttgatagaaaaatcgcagaaaaggatgaggaaattgaccagctgaagagaaaccacactagagtcgtggagacaatgcagagcacgctggatgcagagattagaagcagaaatgatgctctgagagtcaagaagaaaatggaaggagatctgaatgaaatggaaatccagctgaaccatgccaatcgcttagctgcagagagtttaaggaactacaggaacacccaaggaatcctgaaggaaacccagctccacctggatgatgctctccggggccaggaggacctcaaggaacagctggcaattgtggagcgcagagccaacctgctgcaggctgagatcgaggagctgtgggccactctggaacagacagagagaagcaggaaaatcgccgaacaggagctcctggatgccagtgagcgtgtccagctcctccacacccagaataccagtctcattaacaccaagaagaaattagaaaatgacgtttcccaactccaaagtgaagtggaagaagtaatccaagaatcacgcaatgcagaagagaaagccaagaaggccatcactgatgctgccatgatggctgaggagctgaagaaggaacaggacaccagcgcccacctggagcggatgaagaagaacctggagcagacggtgaaggacctgcagcatcgtctagatgaggccgagcagctggcgctgaagggtgggaagaagcagatccagaaactggaggccagggtacgtgagcttgaaggagaggttgaaaatgaacagaaacgtaatgcagaggctgttaaaggtttacggaaacatgagcgacgagtaaaagaactcacctaccagactgaagaagatcgcaagaatgttctcaggctgcaggacttggtagataaattacaggcgaaggtgaaatcatacaagagacaagctgaggaggctgaggaacaatccaatgctaatctatctaaattccgcaaactccagcatgagctggaggaggccgaggaacgggctgacattgctgagtcccaggtcaacaaattgcgagtgaagagccgagaggttcacacaaaaatcagtgcagagtaaacacacctgcctgatgctatcaagaggctgaagaaaggcacaaaatgtgctatttttggtcacttgctttatgacgtttattttcctgttaaagctgaataaataaaaactacagtaaatgtatacattaaa

SEQ ID NO: 19272 - DNA, 6038 bp, Homo sapiens
atttccaccaagaacccagagagtggaacacttctgaacctgcatttttatctggaactccagaggcagaatcctttgctaaataaatcgcagccatgagtgcgagctcagacgctgagatggctgtttttggcgaagctgctccctaccttcgaaaatcagaaaaggagcggattgaggcccaaaacaagccgtttgatgctaaaacatctgtctttgtggcggagcccaaggaatcctatgtgaagagcactatacaaagcaaagaaggagggaaagtaaccgtaaagactgaaggtggagcaactctaactgtcagggaagaccaagtcttccctatgaaccctccgaaatatgacaaaattgaggacatggccatgatgactcatctacacgagcctggagtgctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgttgactgatcgagagaatcagtccatcctgatcaccggagaatctggtgccggaaagactgtgaacaccaagcgtgtcatccaatactttgcaacaattgcagttactggagagaagaagaaggatgaatctggcaaaatgcaggggactctggaagatcaaatcatcagcgccaatcccctactggaggcctttggcaatgccaaaactgtgaggaatgacaactcctctcgctttggtaaattcattagaatccactttggtactacagggaagctggcatctgctgatatagaaacatatcttttagaaaagtccagagttactttccagctaaaggcggaaagaagctaccatattttttatcagatcacttccaataagaagccagatctaattgaaatgctcctgatcaccaccaacccatatgactatgccttcgtcagtcagggggagatcacagttcccagtattgatgaccaagaagagttgatggccactgatagtgccattgacatcctgggcttcactcctgaagagaaagtgtccatctataaactcacaggggctgtgatgcattatgggaacatgaaattcaagcaaaagcagcgtgaggagcaagctgagccagatggcacagaagtcgctgacaaggcagcctatctccagagtctgaactctgcagacctactcaaagccctctgctaccctagggtcaaggttggcaatgagtatgtcaccaaaggccagactgtgcagcaggtgtacaatgcggtgggtgctctggccaaagccgtctacgagaagatgttcctgtggatggtcacccgcatcaaccagcagctggacaccaagcagcccaggcagtacttcatcggggtcttggacattgctggctttgaaatctttgattttaacagcctggagcagctgtgcatcaacttcaccaacgagaaactgcaacagtttttcaaccaccacatgtttgtgctagagcaggaggagtacaagaaggaaggcatcgagtggacgttcattgactttgggatggacctggctgcctgcattgagctcattgagaagccactgggcatcttctccatcctggaagaggagtgcatgttccctaaggcaacggacacctccttcaagaacaagctgtatgaccagcacctgggcaagtctgccaacttccagaagcccaaggtggtcaaaggcaaggctgaggcccacttctctctgattcactatgctggcactgtggactacaacattactggctggctggacaaaaataaggaccccctgaatgatactgtggttgggctgtaccagaagtctgcaatgaagactctagccagtctcttttccacgtatgctagtgctgaagcagatagcagcgcgaagaaaggtgctaagaaaaagggctcttctttccagactgtgtctgcccttttcagggaaaatttaaataaattgatgacgaatctgaggagcacacaccctcacttcgtacggtgtatcattcccaatgaaaccaaaactcctggggcaatggaacatgaacttgtgttgcaccagctgaggtgtaatggtgtgctggaaggcatccgcatctgtaggaaaggattcccaagcagaatcttatatggtgatttcaaacaaagatacaaggttttaaatgcaagtgctattccagagggacagttcattgacagcaagaaggcttctgagaaacttcttgcatctattgatattgatcatactcaatataaatttggacataccaaggttttcttcaaagctggacttctgggtcttctggaagaaatgagagatgaaaaattagcccaaattataacaagaacacaagctgtctgtaggggattcctaatgagggtagaatatcagaagatgttgcaaaggagagaagcacttttctgcatccagtataatgtccgtgccttcatgaacgtcaagcactggccctggatgaaactctttttcaagattaagcccctcctcaagagtgcagagaccgagaaagagatggccaccatgaaggaagaattccagaaaaccaaagatgaactcgccaagtcagaggcaaaacggaaggagctagaggaaaaaatggtcactctcttaaaagagaaaaatgacctgcaactccaggttcaatctgaagcagatagcttggctgatgcagaggaaaggtgtgagcaactgattaaaaacaaaatccaacttgaggccaaaatcaaagaggtgactgaaagagctgaggaggaggaagagatcaatgctgagctgacagccaagaagagaaaactggaggatgaatgttcagaactcaagaaagacattgatgaccttgagctgacactggccaaggttgagaaggagaaacatgccacggagaacaaggtgaaaaatcttacagaagagatggcaggcctggatgaaaccattgcaaaactgtccaaggagaagaaggctctccaagagacccaccagcagaccctggatgacctgcaggcagaggaggacaaagtcaacatcctgaccaaagctaaaaccaagctagaacagcaagtggatgatcttgaagggtctctggaacaagaaaagaagcttcgaatggatctagaaagagcaaagcggaaactggagggtgacctcaaattggcccaagaatccacaatggatatggaaaatgacaaacagcaacttgatgaaaagcttgaaaagaaagaatttgaaatcagcaatttgataagcaaaattgaagatgagcaagctgtagaaattcaactacagaagaagatcaaagagttgcaggcccgcattgaggagctgggggaagaaatcgaggcagagagggcgtcccgagccaaagcggagaagcagcgctctgacctctcccgggaactggaggagatcagcgagaggctggaagaagccggtggggcaacttctgctcaggtggaattgaacaagaagcgggaggctgagtttcagaaactgcgcagggacctggaggaggccaccctgcagcatgaagctatggtggctgctcttcggaagaagcacgcagacagtatggctgagcttggggagcagattgacaacttgcagcgggtcaaacagaagctggagaaggagaagagtgagctgaagatggagactgatgacctcagcagtaacgcagaggccatttccaaagccaagggaaaccttgaaaagatgtgccgctctctagaagatcaagtgagtgagcttaagaccaaggaagaggagcagcagcggctgatcaatgacctcacagcacagagagcgcgcctgcagacagaagcgggtgaatattctcgacaattagatgagaaagatgctttagtctctcagctttcaaggagcaagcaagcatctactcagcagattgaagagctgaaacatcaactagaggaagaaactaaagccaagaacgccctggcacacgccctgcagtcctcccgccatgactgcgacctgctgcgggaacagtatgaggaagagcaggaaggcaaagctgagctgcagagggcgctgtccaaggccaacagtgaggttgcccagtggagaaccaaatacgagacggatgccatccagcgcacagaggagctggaggaggccaagaaaaagttggcccagcgcctgcaagaagctgaggaacatgtagaagctgtgaacgccaaatgtgcttcccttgagaagacgaagcagcggctccagaatgaagttgaagacctcatgcttgatgtggaaaggtctaatgcagcctgtgcagcccttgataagaagcaaaggaactttgacaaggtcctatcagaatggaagcagaagtatgaggaaactcaggctgaacttgaggcctcccagaaggagtcacgttctcttagcactgagctgttcaaggtgaagaatgtctatgaggaatccctggatcaactcgaaacgctaagaagagaaaataagaacttgcaacaggagatttctgacctcactgagcagattgcagagggaggaaagcaaattcatgaattggagaaaataaagaagcaagtagaacaagagaaatgtgaaattcaggctgctttagaggaagcagaggcatctcttgaacatgaagaaggaaagattctgcgtatccagcttgagttaaaccaagtcaagtctgaagttgatagaaaaatcgcagaaaaggatgaggaaattgaccagctgaagagaaaccacactagagtcgtggagacaatgcagagcacgctggatgcagagattagaagcagaaatgatgctctgagagtcaagaagaaaatggaaggagatctgaatgaaatggaaatccagctgaaccatgccaatcgcttagctgcagagagtttaaggaactacaggaacacccaaggaatcctgaaggaaacccagctccacctggatgatgctctccggggccaggaggacctcaaggaacagctggcaattgtggagcgcagagccaacctgctgcaggctgagatcgaggagctgtgggccactctggaacagacagagagaagcaggaaaatcgccgaacaggagctcctggatgccagtgagcgtgtccagctcctccacacccagaataccagtctcattaacaccaagaagaaattagaaaatgacgtttcccaactccaaagtgaagtggaagaagtaatccaagaatcacgcaatgcagaagagaaagccaagaaggccatcactgatgctgccatgatggctgaggagctgaagaaggaacaggacaccagcgcccacctggagcggatgaagaagaacctggagcagacggtgaaggacctgcagcatcgtctagatgaggccgagcagctggcgctgaagggtgggaagaagcagatccagaaactggaggccagggtacgtgagcttgaaggagaggttgaaaatgaacagaaacgtaatgcagaggctgttaaaggtttacggaaacatgagcgacgagtaaaagaactcacctaccagactgaagaagatcgcaagaatgttctcaggctgcaggacttggtagataaattacaggcgaaggtgaaatcatacaagagacaagctgaggaggctgaggaacaatccaatgctaatctatctaaattccgcaaactccagcatgagctggaggaggccgaggaacgggctgacattgctgagtcccaggtcaacaaattgcgagtgaagagccgagaggttcacacaaaaatcagtgcagagtaaacacacctgcctgatgctatcaagaggctgaagaaaggcacaaaatgtgctatttttggtcacttgctttatgacgtttattttcctgttaaagctgaataaataaaaactacagtaaatgtatacatt

SEQ ID NO: 19273 - DNA, 870 bp, Homo sapiens
ccagggatgaccccactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaa

SEQ ID NO: 19274 - DNA, 1065 bp, Homo sapiens
tgcccttatgccgtttaacactctgggtccatcttcaagacactgggctgtggatcaacccaaccaccactcctcttccaagaatcattttgacaggttcttttggaggaactccttctctttttaacccacccttttaaaaaaaaaaatggcaccaaagaaagacgtgaagaaacctgtggctgcggctgcggctgccccagccccggcaccggcacctgcacctgcccctgccccagccaaacccaaagaagaaaaaattgacctctctgccattaagatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaa

SEQ ID NO: 19275 - DNA, 1210 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccacttggtcccgccgcgccttccggtgcgccttccggtgcgccttccggtgcgccttccgctccgccccttcaggcaggaagtgtcggcgccgccactgtccggccacagcctaacgctcttcgctgtcgtttgtggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 19276 - DNA, 1064 bp, Homo sapiens
actgaaggccttggattcaaccttaagagggagaacttagcgtttccggctagatgtgtgggaggtggtaacgagcaaaactcaaaagctgggaattgtgtcctgtgaaaagcaggccgtggggacaccggcgggtatggaacagaactgtaatgactaatagtcggaaataagggtagatagaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 19277 - DNA, 1025 bp, Homo sapiens
ctgccctcccggcgccgcggcgggtcctggcggtggattggggccgacccgggcgtgttcgtgtggagcacctgccctgtgcccaacactatcctagatgctttggagggtggaggagcctcctgttgcacggtcttgcctaagaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 19278 - DNA, 1249 bp, Homo sapiens; identical to SEQ ID NO: 19167

SEQ ID NO: 19279 - DNA, 792 bp, Homo sapiens
gcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgtatttggtcacga

SEQ ID NO: 19280 - DNA, 924 bp, Homo sapiens
atccgggcaggataaaggcctgggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggccttcc

SEQ ID NO: 19281 - DNA, 1012 bp, Homo sapiens
cctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggtaggcacccactccctcctgaacccgctgctgccacctgcccacactccaccagctgcagtgctcacttgacatcctgctgcctccgtctccctcctcctctgtaatctgcactgcctttgctctcaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggccttcc

SEQ ID NO: 19282 - DNA, 451 bp, Homo sapiens
gacgcgggagtgtggagaggccgagaggagccttccgccccccgccccgggacattgcgctagaggccgaggcccggagtcttacggcggcgggatgtcctgggaaaatgtagctgtggaagagcagaacattcctccctcctgtgatggctgacattcataggaaggcggacacacggaagacgccaggtaacaagagcccagaagaaggccggcgtggccgggctttcctgccttagtccacaggctcctcagaagtcagggcccatatcttccccgcattctccttggctgggggaagggagagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttc

SEQ ID NO: 19283 - DNA, 907 bp, Homo sapiens
ctctctggctgctccggcatatttgagaaggtctgtttccctggtccttctgggtttccaccaattggcaagaagggatcagcctgtcctagagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctg

SEQ ID NO: 19284 - DNA, 855 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctga

SEQ ID NO: 19285 - DNA, 261 bp, Homo sapiens
cctgaggctcccaaggaacctgcctttgaccccaagagtgtaaaggtaatagggtgtccatgccccagatcgcagtcccatggggcagtgatagacttcactgccgaccagattgaagagttcaaagaggcctttatgggtgctgagcttcggcacgtccttgccaccctggtaattaagagcgcaccacctcccaaacccaccgcaggagagaagatgactgaggctgaagtggagcagctgttagctgggcaagaggat

SEQ ID NO: 19286 - DNA, 666 bp, Homo sapiens
ggagtggcagccggagtctgaactgtcctgggggaccaagcaggagcttaagatgggcaagacctggggccctgggcagacgcatcaaagcaggcagaagcaggcatggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttggaccctg

SEQ ID NO: 19287 - DNA, 584 bp, Homo sapiens
aggaacagggcggagtagcggccgagctgcgaaagaggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacg

SEQ ID NO: 19288 - DNA, 2956 bp, Homo sapiens
acagggcccctgctgcccacccgctcacgcactggctcactcgtcctctgcgaacagggactgcctcccatcaagacctcagcactcgaacagccatttagcacccgttttcaccaagaagcagccgttttcgagtcccccgcccgggcctcagaagcctgagctttgggtgagctgattccactatcggggtcacgctcggtggaggacacggtcctgcagcctcgcatgcgtcccaagcccccttccagagctggagttctccaaatagcacaggagctccacaggaaagccgagcagaccccgccccggccccgcccgcggtcactcactgtagcgcgtggctccgtaggccacaccgaggaacagggcggagtagcggccgagctgcgaaagaggttggtcagaggcggcgcgaaacggggctcgcgggacgggggtcgcgggaggagggggggcggggtcgctgggcagaggtcgcaggaggggtgggggtccggtcgccgggcgagggtcacggggcgaggatcatgggggcgggggccgggggtcgcagcccgcggggtcggagctgcggggcgggacacgggggggcccagagcactgggcggcggctgcaaagcctggatcaccttgatgagcggagagacctgcaccggtggcaccatcttgtccctgacctccgcaccggaagcacaacctgcagacggagcaggatgccgcacaagccagcaaagccttggaggcaaaggcggagctgggcgcacgcatgcgccgtcagcggcgagagagcggggggccgcgccccctggcgaccgaagggtgactgcgcgcccccgcgcggcggtgacgtcacgtgaggcgcacgcgcacaaaggctggggagtgcgcggaggatcatcggctgcgcctgcgcagttgctgcgtgaggcgggatctgcgccgagtgggcggggggtttcctttccccgcagggctgggggtccgctgtttccccgcgctgctgccgaggccccgccgtccgcgtcctggccgtgtgtccacaccccagactgcgggccggggcgcactctgtcttcttgcgcggagcgtcggaggcctgaggtcagggcggctcgggcgggtccagccccgcggaccgcgcccacccgagggtggcctgggcagggacctgggggtcctgggagcggagtgtgagccgagtgcaggtggctccccgggcaggtccttctcctacaaggcagtagtgtctgtcgccggccgggccgcgttggattccgcggcccgcgggagcatggcctccaggcccctcttcctgcggctgctctgcccgggagcacggggcgcccttcatcccggagctggagcttcctcaccccaggatgccccatcacttctgtcccgaagaggggctgggatcttcttgggaagaccagcccccaacagaggctgctccctgggtcccccgactccaggcctcaggactccacggctccaagggcctgccccggcccaggcctggggaccactgagccccacactggtctttgctggcctctgtccacctcccggtagctgtgtgtctcccacagctgcccagagatggggcctgcggtgcctatgcagcctccccgctgtgcccgaagtgctgacccgccagccccatggacaccaggcttggagtctaggcaggagcctggcaccccctccacgttctgggtcttcctggcggcagccatgctgcccgtgctgggccaccctcgggccccctttggccccatgcagtagtgacgcaaggcctcctgtgtcccctcctggccctgcactgctacaggcagaagcaactggagaactatggctcgggtctcgctaaggtgcagcatcacaaactccaggactcttgaagcaagcatggggaggacccgtgatcctggcggcctgggctacctgtccgggcctaagtcgcctctgccccctctcctggcttgctctggggtccagggcctgggcctctctggctgagaaactaggaagtcactgggctctgtttcctgagctgggtataccaaggccagtcctatagggcaggggtccccaacccccaggtgcagaccagtaccagcttgtggcccgttaggaaccgggcagcacaggacgaggtgagggagcatgattgcccgagctccacccactttcagatcagcctgggcatcagattcccataggagcgtgaaccctactgtgagctgcgcacttggatctggattgcgctctgggggccagaagcaaactccagccctccccgtgtctactgctcgctgaggaagccgcaggtgcacactggatccacaaggcacagaaccatcttggccctcggcaagcccccgcttccgccagggcagacggcctcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttgg

SEQ ID NO: 19289 - DNA, 781 bp, Homo sapiens
gggtccgctgtttccccgcgctgctgccgaggccccgccgtccgcgtcctggccgtgtgtccacaccccagactgcgggccggggcgcactctgtcttcttgcgcggagcgtcggaggcctgaggtcagggcggctcgggcgggtccagccccgcggaccgcgcccacccgagggtggcctgggcagggacctgggggtcctgggagcggagtgtgagccgagtgcaggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttgga

SEQ ID NO: 19290 - DNA, 655 bp, Homo sapiens
attactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 19291 - DNA, 753 bp, Homo sapiens
gtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcgggtacggctcctcccagcctctcctctagttgatctccccagtgtttcttttttccccaacctgtgctctttatcccctgcccttaccctactaccatctgacttcctcctggcatgtttctgcatggagctgactagggaggggagggattcctcaaagaggaagacaacctgggggtacagtacctccttacctctagaatgggccctgaggttttacttatgcggccctgggtgctggtgtctgggaactctcaccagcctgtataccagtct

SEQ ID NO: 19292 - DNA, 901 bp, Homo sapiens
ctccccccacgaccccccccacctccgagcgggttctgtgcccaggtggcgctggagaaaggaacagcggaccccgcccaagtcattactaatgtagcaatcgtctgcataaacccaggccacggttcctattggctgagtcctctgagggtgacgtcatcgggacgtactaagactagggttgggccgagagtcggagccattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 19293 - DNA, 869 bp, Homo sapiens
ggccaccggaattaacccttcagggctgggggccgcgctatgccccgccccctccccagccccagacacggaccccgcaggagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctctcttggtttca

SEQ ID NO: 19294 - DNA, 1034 bp, Homo sapiens
agtcaccaaccaccgccatgggccggaagccaccgccctcgcgtcaactgcaatctagagcgcggcgcatcccgtgagcccgcggggaactacgactcccggcatgctccgcggccaccggaattaacccttcagggctgggggccgcgctatgccccgccccctccccagccccagacacggaccccgcaggccaactggctccctgcccctgcccccgccccttgacatcccagactccctggctatttaaacagagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctc

SEQ ID NO: 19295 - DNA, 562 bp, Homo sapiens
atgccccgccccctccccagccccagacacggaccccgcaggttcacacaagcctccctggctgctacccctcaccccacccttcaagaagactaaagctgctggatcacctgctttgcctcaccacccccatctcagtgccactggcaagcatcctatcctcaccctggaggttaactacctcattctgggcagtctctggcttcctcccctacccctaaaggaaacattgttcttttctggtcagcctttggggataaggggacagagggaagaagaccttggggcaggagtcctgaaccataggaggccaggggagtgagggcaggcggttatatctctcctctacctcatctttgccacagccaactggctccctgcccctgcccccgccccttgacatcccagactccctggctatttaaacagagatgggtgcccccatccgcacactgtcctttggccaccggacatcatgcctcccaagaaggatgttcccgtgaagaaaccagcagggccctccatctccaaacctgctgctaagccagcagcagcaggggct

SEQ ID NO: 19296 - DNA, 1305 bp, Homo sapiens
ctttcagcagtaggtccaggaaaacagccgccccgccccctccacctcccgagactaggagcccgccagggttaagtaggagggataccctaggggccccgcagggtttttagggttggggtggattggaaattgttcattgcctttcagttccgggacataaagcgcgctggaaggacactgagtcaccaaccaccgccatgggccggaagccaccgccctcgcgtcaactgcaatctagagcgcggcgcatcccgtgagcccgcggggaactacgactcccggcatgctccgcggccaccggaattaacccttcagggctgggggccgcgctatgccccgccccctccccagccccagacacggaccccgcaggagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcaggtagggccctcccaccccttcgccgcgccttacgaggcaagtctcccgcccttctctcagccaacatagaaaagcagcggagttcattctgctgtccggttgctgcacgggctccagcgcttcgcaactttggtttttttccacagatccagtggggtccggacactgggccccgcaggcgaaagcacgttccagccaccaggaggccacctattgtttcaaaataaagactgggttcctctcttgg

SEQ ID NO: 19297 - DNA, 612 bp, Homo sapiens
gacagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 19298 - DNA, 791 bp, Homo sapiens
aagaaaggctagcggtctcccaggtgctggcctttgggctgggggagcagagttttctgtgcttgtgttgggttgagggtggtccccagggagaggaagaggatcctggccctggctctcctgggaatgctctgggactgtgcatgatgggtggggtggggagactctgaggagttggggagaggacccctccctactcacagtgttgcaggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgg

SEQ ID NO: 19299 - DNA, 2635 bp, Homo sapiens
agattcactggtgtggcaagttgtctctcagactgtacatgcattaaaattttgcttggcattactcaaaagcaaaagaaaagtaaaaggaagaaacaagaacaagaaaaaagattatattgattttaaaatcatgcaaaaactgcaactctgtgtttatatttacctgtttatgctgattgttgctggtccagtggatctaaatgagaacagtgagcaaaaagaaaatgtggaaaaagaggggctgtgtaatgcatgtacttggagacaaaacactaaatcttcaagaatagaagccattaagatacaaatcctcagtaaacttcgtctggaaacagctcctaacatcagcaaagatgttataagacaacttttacccaaagctcctccactccgggaactgattgatcagtatgatgtccagagggatgacagcagcgatggctctttggaagatgacgattatcacgctacaacggaaacaatcattaccatgcctacagagtctgattttctaatgcaagtggatggaaaacccaaatgttgcttctttaaatttagctctaaaatacaatacaataaagtagtaaaggcccaactatggatatatttgagacccgtcgagactcctacaacagtgtttgtgcaaatcctgagactcatcaaacctatgaaagacggtacaaggtatactggaatccgatctctgaaacttgacatgaacccaggcactggtatttggcagagcattgatgtgaagacagtgttgcaaaattggctcaaacaacctgaatccaacttaggcattgaaataaaagctttagatgagaatggtcatgatcttgctgtaaccttcccaggaccaggagaagatgggctgaatccgtttttagaggtcaaggtaacagacacaccaaaaagatccagaagggattttggtcttgactgtgatgagcactcaacagaatcacgatgctgtcgttaccctctaactgtggattttgaagcttttggatgggattggattatcgctcctaaaagatataaggccaattactgctctggagagtgtgaatttgtatttttacaaaaatatcctcatactcatctggtacaccaagcaaaccccagaggttcagcaggcccttgctgtactcccacaaagatgtctccaattaatatgctatattttaatggcaaagaacaaataatatatgggaaaattccagcgatggtagtagaccgctgtgggtgctcatgagatttatattaagcgttcataacttcctaaaacatggaaggttttcccctcaacaattttgaagctgtgaaattaagtaccacaggctataggcctagagtatgctacagtcacttaagcataagctacagtatgtaaactaaaagggggaatatatgcaatggttggcatttaaccatccaaacaaatcatacaagaaagttttatgatttccagagtttttgagctagaaggagatcaaattacatttatgttcctatatattacaacatcggcgaggaaatgaaagcgattctccttgagttctgatgaattaaaggagtatgctttaaagtctatttctttaaagttttgtttaatatttacagaaaaatccacatacagtattggtaaaatgcaggattgttatataccatcattcgaatcatccttaaacacttgaatttatattgtatggtagtatacttggtaagataaaattccacaaaaatagggatggtgcagcatatgcaatttccattcctattataattgacacagtacattaacaatccatgccaacggtgctaatacgataggctgaatgtctgaggctaccaggtttatcacataaaaaacattcagtaaaatagtaagtttctcttttcttcaggtgcattttcctacacctccaaatgaggaatggattttctttaatgtaagaagaatcatttttctagaggttggctttcaattctgtagcatacttggagaaactgcattatcttaaaaggcagtcaaatggtgtttgtttttatcaaaatgtcaaaataacatacttggagaagtatgtaattttgtctttggaaaattacaacactgcctttgcaacactgcagtttttatggtaaaataatagaaatgatcgactctatcaatattgtataaaaagactgaaacaatgcatttatataatatgtatacaatattgttttgtaaataagtgtctccttttttatttactttggtatatttttacactaaggacatttcaaattaagtactaaggcacaaagacatgtcatgcatcacagaaaagcaactacttatatttcagagcaaattagcagattaaatagtggtcttaaaactccatatgttaatgattagatggttatattacaatcattttatatttttttacatgattaacattcacttatggattcatgatggctgtataaagtgaatttgaaatttcaatggtttactgtcattgtgtttaaatctcaacgttccattattttaatacttgcaaaaacattactaagtataccaaaataattgactctattatctgaaatgaagaataaactgatgctatctcaacaataa

SEQ ID NO: 19300 - DNA, 2337 bp, Homo sapiens
ggacaggcaagcacatcagatgtcactgtttggcagctgataaaagtcagtggtgctataatactaagcacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctcccaagcagcatgctggctccaacccaggccaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 19301 - DNA, 1474 bp, Homo sapiens
gcacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttga

SEQ ID NO: 19302 - DNA, 3738 bp, Homo sapiens
ctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctac

SEQ ID NO: 19303 - DNA, 3593 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaacactgttttcagggctgtgagtgtgcatgtgttggaaatgtgcatggtggccatctgatttctttgcccgggtctgcttcatgtactttttatctcaccggcaaccttgcagggctctcccaaaatttcagcaagattgggcatttaagtgtattaaacagtgcagattttaagagtca

SEQ ID NO: 19304 - DNA, 1774 bp, Homo sapiens
ggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgat

SEQ ID NO: 19305 - DNA, 1943 bp, Homo sapiens
agccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacaggctctccactttctctctctgtctctctgtagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgcc

SEQ ID NO: 19306 - DNA, 1954 bp, Homo sapiens
agccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactggacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatata

SEQ ID NO: 19307 - DNA, 2755 bp, Homo sapiens
gggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgtat

SEQ ID NO: 19308 - DNA, 564 bp, Homo sapiens
aaaatgcacggaattgctcctgcttcaagatgtcaagaccgagggagcttgagctgttctataccttttccgggaaggacaactgagtcccacaggatcacatgttgaatggtgtaaacagcttatagctgctacaatttctagtcagatttcaggttcagtgacatcagaaaatgtgtccagagattacaaggttttcaggaggcctgatctaagggagattcaggaagaacacaatggctacccttctgaagctgaagctgatcaggtggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaactt

SEQ ID NO: 19309 - DNA, 549 bp, Homo sapiens
aagatgtcaagaccgagggagcttgagctgttctataccttttccgggaaggacaactgaggatcacatgttgaatggtgtaaacagcttatagctgctacaatttctagtcagatttcaggttcagtgacatcagaaaatgtgtccagagattacaaggttttcaggaggcctgatctaaggaatttagcaactaaaaaaaaaaaggagattcaggaagaacacaatggctacccttctgaagctgaagctgatcaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaac

SEQ ID NO: 19310 - DNA, 573 bp, Homo sapiens
ttgctaaaatgcacggaattgctcctgcttcaagatgtcaagaccgagggagcttgagctgttctataccttttccgggaaggacaactgagtcccacaggatcacatgttgaatggtgtaaacagcttatagctgctacaatttctagtcagatttcaggttcagtgacatcagaaaatgtgtccagagattacaaggttttcaggaggcctgatctaagggagattcaggaagaacacaatggctacccttctgaagctgaagctgatcaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggctt

SEQ ID NO: 19311 - DNA, 4516 bp, Homo sapiens
gcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggttttcaggaggcctgatctaagggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcgtagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgta

SEQ ID NO: 19312 - DNA, 1828 bp, Homo sapiens
gcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatga

SEQ ID NO: 19313 - DNA, 700 bp, Homo sapiens
ggaggaattgctaaaatgcacggaattgctcctgcttcaagatgtcaagaccgagggagcttgagctgttctataccttttccgggaaggacaactgagtcccacaggatcacatgttgaatggtgtaaacagcttatagctgctacaatttctagtcagatttcaggttcagtgacatcagaaaatgtgtccagagattacaaggttttcaggaggcctgatctaagggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttg

SEQ ID NO: 19314 - DNA, 1967 bp, Homo sapiens
caggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatgagtgctagaccctggacctcctgactccgagttcatgtagtctccgctgcaccaactccaaaaccgtgggattctgcttttcatcctctgtggtgttggccagatcatacttgaaggccttggaaatggagtctgctgattagccaaaaagcccactttaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 19315 - DNA, 2162 bp, Homo sapiens
atggggtggggaggaattgctaaaatgcacggaattgctcctgcttcaagatgtcaagaccgagggagcttgagctgttctataccttttccgggaaggacaactgagtcccacaggatcacatgttgaatggtgtaaacagcttatagctgctacaatttctagtcagatttcaggttcagtgacatcagaaaatgtgtccagagattacaaggttttcaggaggcctgatctaagggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttca

SEQ ID NO: 19316 - DNA, 1451 bp, Homo sapiens
gtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagctttggtatcaggatacagctagcctcatggaatgaactaggaagtatgccctcctcttctagtttttggatgacccatcatctcttacctcacctacagcaggaaccttgaaattggacttctgcctcacaccctgcaatctcatctccacattatgaccagagtgatcttcttttttaaaaaaaacttattgttactatttcaattgataaatgaattgtatatatttatggtg

SEQ ID NO: 19317 - DNA, 4314 bp, Homo sapiens
gcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcgtagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 19318 - DNA, 2215 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggagcatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattcta

SEQ ID NO: 19319 - DNA, 4966 bp, Homo sapiens
gagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgcatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattactaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaatactgtacttggt

SEQ ID NO: 19320 - DNA, 5187 bp, Homo sapiens
ggggcgagcggtgtcagcggcggagccggatgcgggcggcatcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattactaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaat

SEQ ID NO: 19321 - DNA, 2494 bp, Homo sapiens
aagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcc

SEQ ID NO: 19322 - DNA, 2105 bp, Homo sapiens
agtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaata

SEQ ID NO: 19323 - DNA, 2368 bp, Homo sapiens
aaacatccggcgggacggggcggggccggaagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccaggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 19324 - DNA, 2433 bp, Homo sapiens
gttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgagcgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcc

SEQ ID NO: 19325 - DNA, 4681 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagtgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaagtttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaacgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataactttgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 19326 - DNA, 3350 bp, Homo sapiens
gggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactt

SEQ ID NO: 19327 - DNA, 4787 bp, Homo sapiens
agatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaagtttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaacgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataactttgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 19328 - DNA, 3420 bp, Homo sapiens
gaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggcccatgcagtccagttcgggagctaagtcacttaaacactgtgtgatagttcctacacatctcattatagtttgtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaacttt

SEQ ID NO: 19329 - DNA, 1450 bp, Homo sapiens
aattcgcggattctggtttctgaaggctacgccggaattccttccccgggacttgggaaccacttctgcctccctccctggggcgtggaggctgaggaaaaggagttaatgtgttaagagccattgacatttgaagatcatcagaagtgaagataaaacatctcaaaaattataatgggaatacttccagcttttacccattcagtgtgatgttggctgtagctctcactattttgagtgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgc

SEQ ID NO: 19330 - DNA, 8906 bp, Homo sapiens
agcgcgctctgtgtggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcagggacactgaccgtgttgatcaaacgtggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaattctttgccctgtggtttatcccctcttcgtcccttttccctctcacacagaagtgtttgagggcctgctgggaaactgacctttggcaaaggaaagctacagatagccttccgactctagaccttggcaaggagcctcaccatgatgttcaagcactgaacgcatttcctcagtgattttgctcctaaaatctcccaggctaaaagagggcaaagcagtcagggatctgacctggcagctattcctccttctctgaagagttcccatcagtagtcattacaactacctctcgcctcaaggctccatttttagctgctgctctgatttcagggcagccagtactctggccccttcagtcggggagtggaaggagatgtggggtgggggtgagaaaatgcttctgcctgttgttcttgaaggatagactatgggtgggcagagagaactgggggcagaaatggaattagatgtgattgggttatgcagtcaactagaggtctccttcccgccctctctccacacagagaggaacctctgctccttagctcttacagcaggactgtggcatctagtcacttcaatactagttcttgctcttcacagaggtagatttttctttaccctacagcactgttgggcatccctcccatcacatgggtctgtgggtgagatatgttatgctgttcctccctcgggaaggttggtattgaggggtgccttgctccagaggcgccagcccagcatctgtggtgagttggctaagatccagagtgacctgctcagagctccccagaggccttcactctttggggcagtctctctagggtcactttctgaatgtaccttctacctaaagtatacaaacacaaagagccagctgagctggttctagtgtgaaagccgtaagtgccacccagcaggcgtttgaaaacaagaaatcattcttctgtggaaggagaatgtgccatctcagctaccctcagtccgccaggcagcccagtctgtgtattcatatgaagttgtgaaaaccatgagtgtgtgccatggccatcgtgtctacacacagccactattgttcctgtgggctagtctccagcaaattaaaacactggcatggcctaggaagggcgttgcgagctcctaaatggaaagcttctctgggggtagggagatgaagagccaagatgctggtgaagcaggtgcagtgaggatccaaggcaaggaattgccctgagggaggtggctgcatatggagaaaggcagttctctgtgggcaaggccagcttgcttcaggctgtagagggaatttggtctgaagcaacagggcatgaactgtgactttgagctgccaggttgtcttcatctcagaactttcctatcctggcactctcgttacctttcttctataccttggcctctgtaactgcagtccaaaacaagttacagctgccttaatccactgagattctctatgaggatgtacagaaaagttttcctgtaataattttgcttatatgctaactcttttcatgttagcaaagaatattctatgaattagaatgttactgtggtagatctaaaggagaatgaacagaaggtgctggaggacctgttaaacaatctctggctattaaaaaacatcaagatgagaattaaaggcatatcctgatatacttgcctgcttgcacatgaggctgggagatcccatgcctgttgaagttaactctagccctgacctctattgatcttttgggaatgagggctgatttgaaggtgctgttgcaggatttcatttagctgctgccagttcaagtgacctgtccccagggctgcagctgtatccacctgattgcagtaggtgagggctaacagcagaatttaaagtggaccctgggctgtggagcaaagtgactatccatttggacttttggataatgtggcaggagtcccagctgtttaatttctagtcacattttccagaaagttgttctaagttgagattactgacaagatttctcaagggcaggaccagatatgtgagagacttctagttcagagctgacccctctaagcctctgacacttaaacacgagtcctgctgtccccagcacacaactgcactgaagccttgttcctctcggctggtgtagagctcatctgcatgttgtgtgcagataccagtagcctccctgcttgaacaggcctctcctaggctaggcaggtgttcagaggcatgaaggtctgggcaggggaagggcgtcttctgaaatgggagttaccaggtttttaaatgctgctattgttttatttaccatttaaggtcttttctattatatctgagtaactagtcagtttttcttacagtgctcatagcagttgtatttgaattgtattttcagtgaaatttgttttacattgccatttaaaattggcctttaacagcttcccaactagcttataagatttttttttttaatgaaaacataacccatgaggctcagatgctgttgaagaaataaatggtatgttgctgctgacagtagtgcttgcctattgtaacagcattggttctgctgtagcctcggtgaccatttaagttgaataaatctgtcattttcacccacaaacagttgttgagcccctggatttgggttgtcactgtggttctcctgccagtgctataatccagtgtcgtaggtgcagggtatgaatcagctcagcctcttaggagagaggggctctcagcgaggagggggcggggggggggtcactatttatcttccagaggcagggttcatggattcctgatgtttagaggcggaagggaccttaggtcacctacttccacggttttcatactgttctctggggcctcgtggagagggagcctccaggcccattcaaagctttattagatttaaaagtaagatctggtatgaagaaaggttttgtttgtttcttaaaataaaaagtctgaaaatcact

SEQ ID NO: 19331 - DNA, 4464 bp, Homo sapiens
agaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatg

SEQ ID NO: 19332 - DNA, 6018 bp, Homo sapiens
ggctcggcgtcgggagcgcgctctgtgtggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaa

SEQ ID NO: 19333 - DNA, 3758 bp, Homo sapiens
cctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcagggacactgaccgtgttgatcaaacgtggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttccctt

SEQ ID NO: 19334 - DNA, 665 bp, Homo sapiens
tgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtct

SEQ ID NO: 19335 - DNA, 5829 bp, Homo sapiens
gcgcggcctcagcagctgcgggagacggaagtggcaagagcgcggcctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtgctgc

SEQ ID NO: 19336 - DNA, 4102 bp, Homo sapiens
cacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcaatcttcttggccaaagcaataacagttgaaaatgcaagtgtgttggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttcctctctacagttccgaatctcacagatttacagttttggagccaaatacagtatctttcaattttaagttttggaggaacatgtaccatcaatttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaataagtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatatatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattacttcatatatgatttaaaggtaattaaatgttcacattttactttgaatgtttttcttctggataaaacaaatggaatc

SEQ ID NO: 19337 - DNA, 5659 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcaatcttcttggccaaagcaataacagttgaaaatgcaagtgtgttggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcaatttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaataagtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatatatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattacttcatatatgatttaaaggtaattaaatgttcacattttactttgaatgtttttcttctggataaaacaaatggaatcaagttgtagttgttttttttttcttctcacctaggcaagtagacttgcccattacattaacataacagcataaggtttgaggagtttattttccaaaagtttgttgataaataatacctgtttcatacaaaaataatttccagaatatttaaaataggtatagtgggctaaaaggcccatcagatgtaggtaataatgtcattaagttttcattttgttcctgtcacttgcttatattacaatcactatttttttgtgcccttgccaacttgatggaaggcagggtccattgagtacaaacattcgaggtgaaatgtctctccaaaggcagatctggatgtaaatatgaggaagaaaataactggctgacaagaggataattttattgagggtgttttgaaaaggtcagctaggctagaagtagctcagggaatcttgagtaaagatgaagggaactcttttaaaacaaattcaatttatttggtcgggtagcagagcagggaggtggtgtcagtcaagcctgttttgaaacattttttgcagaaggtcagctttaaaatattgaaaaatttccagttgacatgctaagttggattaaatgctgatcatttataaaactatatagttgctgcaaaagtaattggggcttttgccattgaaagtgatgacaaaaaccgcaattacttttgcaccaacctaatactacagttgcagacttttattagtgacgctgatcttcattagtcaagttttagttattttgttggcttttccatgtagaattccaagtgacattaacatactttgattaattaaagaaaatttggagactgtttaagatatatgtctagatatcaatgtaaactataagctttaggaacttacatctagaagaaagcctggaatctagaataattatctcaaaaaaaagtatatataccattgtacttgatataagaaaatgtaaacatgaaaccttgacattttaataaacagtatttgtgctactctagttatttctaggaaagtaaaa

SEQ ID NO: 19338 - DNA, 2337 bp, Homo sapiens
cagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcaatcttcttggccaaagcaataacagttgaaaatgcaagtgtgttggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcaatttgatcgaacactgcatcctaggcagtctgtatttaatataattatgaatatgaatgagcaaaataaacaattagagaaagatattaaagacctagaatctctaacctcttactcatccttcaagatcatcgtaggccaatgaatccttgaatttgtggtcaacaagaggtcttctgtaggctgaagtcagggctgagtggtctgcttgtgatctcctaggaattcaagtaaatccatgtacttcttgaacatagctcatagcagaggactgagccgtgaaaatgcttacatgcctgcctcctctgacacattataagctccctgaggatggggaccaaggcttatttcatcgttgtatcctcagcatctgaccaatagcaggcactaagtcattactgaaaagaactgagcatgacacccaagggaacagatgaggtggaggtaggacaaggaagactgaggagtctccatggaaccttccagggagagacagtcaataaactctcatcagtc

SEQ ID NO: 19339 - DNA, 1963 bp, Homo sapiens
cagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcaatcttcttggccaaagcaataacagttgaaaatgcaagtgtgttggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcaatttgatcgaacactgcatcctaggcagtctgtatttaatataattatgaatatgaatgagcaaaataaacaattagagaaagatattaaagacctagaatcttttacaagttttgctgctgcaagagtgatacaaggtcag

SEQ ID NO: 19340 - DNA, 3850 bp, Homo sapiens
gcgcccgcccgggaccctgcagacgtgggccagccatggagcacatccgtacgcccaaggttgaaaatgtccgcttggtagatcgagtgtctcctaaaaaagcagctctaggtactttgtatttgacggctacccatgtcatattcgtggaaaattcacctgacccaagaaaagaaacatggattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactacagagtctgtgactcttatcctactgaactgtacgttcccaaatcggccacggcacacatcatagtggggagttccaaattccggagtagacggcgatttcctgtcctttcttactattataaagataaccacgcctccatctgccggagcagccagcccctgtccggcttcagtgcccggtgcctagaggacgagcagatgctccaggccattaggaaagccaatccaggaagtgacttcgtttatgtcgttgacacccggcctaaacttaatgcaatggcaaatcgtgctgcagggaaaggctatgagaatgaagacaattattccaatatcaagtttcagtttatcgggatagagaacatccatgtcatgaggaacagtctgcagaaaatgctggaagtgtgtgaacttaaatctccctccatgagtgatttcctgtggggtctggagaactctggctggttaaggcacattaaagccataatggatgcaggaatcttcattgcaaaggcagtgtcagaggaaggggcaagtgtgcttgttcactgttctgatggctgggacaggaccgctcaggtgtgctcggtggcaagcctgctgctggaccctcactaccggactctgaagggcttcatggtattaattgaaaaggactggatttcctttggtcataagtttaatcaccgatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagattcaagaaagaacatactcattatgggctcacctgtggaagaatcgggccgactacctgaatcctctgtttagagctgatcacagccagactcagggaacccttcatctccctacaacaccatgtaacttcatgtacaagttttggagtggaatgtataaccgctttgaaaaggggatgcagccccgacagtcagttacagattacctaatggcagtgaaggaagaaactcagcagctagaggaagaactagaggccctggaagaaaggctggaaaaaattcaaaaggtccagttaaattgcactaaggtgaagagtaagcaaagtgagcccagcaagcactcagggttttctacctcagacaacagcatagccaacactccccaggattacagtgggaatatgaaatcatttccatcccggagcccttcacaaggcgatgaagattctgctctgattctaacccaagacaatctgaaaagttcagatccagatctgtcagccaacagtgaccaagagtccggggtggaggatttgagctgtcggtctccaagtggtggtgagcatgcaccgagtgaagatagtggcaaggaccgggattctgatgaagccgtgtttctcactgcctgaagtttccctttggagttccaaagtaaaggacacataagcaacacttccaaaaacaagggaacaaggtggtttattgtaaaaacaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttctaaaaacaggcacattggtgagatgcaccctttttagttaatagatgcattcctaaggagcttttaattgcttatctttcaggcataatcatcactttaacttttccttggagcatatattttgaattgtgagaataattttgttgcttttctctgagatctatagtctgtttctcctcattatttaaaaatgctaaaccttgtatctcactttttctctaacactgatttaatagctaacgaggtagaagcaacattcattctcctggtcttacatatgaatttaagtatcagctttcttgtaataaccttttattactgttctagagactacactaccgacagtgtgggccagccaccagcctgatctcaaagtatcacattataaagttagtagataaaacatctgtgagtgaaaatccagtttcaagaaccagagaattgggttgtcatgtctgtttaatgaagggaataggttttgtaatctatcattttagaaattatgtaactggctaatatggtttaattaaccttagtaacatctcatgaccactgactgctgaaagttctgaaaagaatttttgttttgttacactgcacatttaagggagagtccctcccctatcttatgagttaaaaaagacttcactaggtgacctaaattaaacttagtggggaaaagtggccatgtttggacataaataaatggtattcacactgtatggttttaatatattagtacattctagaatgtaaaaggattaaactttacaatttagatcaatattttgaatatgtgaaaggattaatttaaactttacaatttacatcaatattttgaatatctgattttttttaatgggagaattattacatttcgctgaaatgaggacgagggcaagaaagcaacattgctgatctctctagtatgaaagatttggagggagtgttgcaatatatataaatgaaaacatttaattgtgttcatcatatttaaaaatatagaatatattagagaactgtgatttaaaagtactgttaatgtaaaaaataaagcaagtgtaattaattctttcagaatataaaatttgggcattctctgctgagcagttcccaaattaagtacaaggaatgtttattcattttctgcaatatactatatgtaatagggaataccttgctaaaataaaacttaggatatagtggtaatggctttcacatttttataacataacataactcacttcacaaccttcttggagctgtccactcttagaaactctgttgcctaatattgaggatgtggctttaatttcttccgtttgacagtgtatgtctataaaaacaataaacattttttaaaaaatgacaaa

SEQ ID NO: 19341 - DNA, 1455 bp, Homo sapiens
attctttgtgactctttgcggatcgtgtgttttctaggcagtgtcagaggaaggggcaagtgtgcttgttcactgttctgatggctgggacaggaccgctcaggtgtgctcggtggcaagcctgctgctggaccctcactaccggactctgaagggcttcatgatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagattcaagaaagaacatactcattatgggctcacctgtggaagaatcgggccgactacctgaatcctctgtttagagctgatcacagccagactcagggaacccttcatctccctacaacaccatgtaacttcatgtacaagttttggagtggaatgtataaccgctttgaaaaggggatgcagccccgacagtcagttacagattacctaatggcagtgaaggaagaaactcagcagctagaggaagaactagaggccctggaagaaaggctggaaaaaattcaaaaggtccagttaaattgcactaaggtgaagagtaagcaaagtgagcccagcaagcactcagggttttctacctcagacaacagcatagccaacactccccaggattacagtgggaatatgaaatcatttccatcccggagcccttcacaaggcgatgaagattctgctctgattctaacccaagacaatctgaaaagttcagatccagatctgtcagccaacagtgaccaagagtccggggtggaggatttgagctgtcggtctccaagtggtggtgagcatgcaccgagtgaagatagtggcaaggaccgggattctgatgaagccgtgtttctcactgcctgaagtttccctttggagttccaaagtaaaggacacataagcaacacttccaaaaacaagggaacaaggtggtttattgtaaaaacaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttct

SEQ ID NO: 19342 - DNA, 2158 bp, Homo sapiens
gcgcccgcccgggaccctgcagacgtgggccagccatggagcacatccgtacgcccaaggttgaaaatgtccgcttggtagatcgagtgtctcctaaaaaagcagctctaggtactttgtatttgacggctacccatgtcatattcgtggaaaattcacctgacccaagaaaagaaacatggattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactacagagtctgtgactcttatcctactgaactgtacgttcccaaatcggccacggcacacatcatagtggggagttccaaattccggagtagacggcgatttcctgtcctttcttactattataaagataaccacgcctccatctgccggagcagccagcccctgtccggcttcagtgcccggtgcctagaggacgagcagatgctccaggccattaggaaagccaatccaggaagtgacttcgtttatgtcgttgacacccggcctaaacttaatgcaatggcaaatcgtgctgcagggaaaggctatgagaatgaagacaattattccaatatcaagtttcagtttatcgggatagagaacatccatgtcatgaggaacagtctgcagaaaatgctggaagtgtgtgaacttaaatctccctccatgagtgatttcctgtggggtctggagaactctggctggttaaggcacattaaagccataatggatgcaggaatcttcattgcaaaggcagtgtcagaggaaggggcaagtgtgcttgttcactgttctgatggctgggacaggaccgctcaggtgtgctcggtggcaagcctgctgctggaccctcactaccggactctgaagggcttcatggtattaattgaaaaggactggatttcctttggtcataagtttaatcaccgatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagattcaagaaagaacatactcattatgggctcacctgtggaagaatcgggccgactacctgaatcctctgtttagagctgatcacagccagactcagggaacccttcatctccctacaacaccatgtaacttcatgtacaagttttggagtggaatgtataaccgctttgaaaaggggatgcagccccgacagtcagttacagattacctaatggcagtgaaggaagaaactcagcagctagaggaagaactagaggccctggaagaagtaagacatacttgctttgttaatctattttctgtgcttatttcttgaagagcaaggcttcatgaaagcctcttaagattcagtgcaatacaaatatttcacatttttagtcagtagaacacctgaaacacaaccccatccaggtcaggactcagataaccgaagcccaaacctaggcatttaatgcatttcacacatctggtttgtggctcagttccacaaatttttggttgttccttattttaggtcaacttgtttggttactgttatttgagagtagtaaaattaatttttttctggaaagtgtgaaaaagtaacagaataaaatcaaatatatgtacttgtaaaactctttccccacttttagaaattatgttaactatgatattaatctataattggtaaaggggagactgactgtaaagtcttatcttttggcttctatgaacttccctgtacttggacagggaggttataataaaatgcttttcctaattggataa

SEQ ID NO: 19343 - DNA, 2228 bp, Homo sapiens
cttgacctattagttcctaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgaattgcagaataaattgaaagaaaatttt

SEQ ID NO: 19344 - DNA, 2639 bp, Homo sapiens
ggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagatatgcagcacctaccctcctgaaatagtggttcctaaatctgttaccttgggaacggtggttggaagttcaaagttcagaagtaaagaacgtgtccctgtgctctcctacctctacaaagagaacaatgctgccatttgccgctgtagccagcctctctctggattttacactcgctgtgtagatgatgagctcttgttggaggccattagccaaacaaacccagggagccagtttatgtatgttgtagacacaagaccaaagttgaatgccatggccaaccgagcagctgggaaggggtatgaaaatgaagacaactatgccaacattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgaattgcagaataaattgaaagaaaatttta

SEQ ID NO: 19345 - DNA, 1981 bp, Homo sapiens
agattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgaattgcagaataaattgaaagaaaatttta

SEQ ID NO: 19346 - DNA, 2200 bp, Homo sapiens
agaaacccgggttgaggcaggaggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagatatgcagcacctaccctcctgaaatagtggttcctaaatctgttaccttgggaacggtggttggaagttcaaagttcagaagtaaagaacgtgtccctgtgctctcctacctctacaaagagaacaatgctgccatttgccgctgtagccagcctctctctggattttacactcgctgtgtagatgatgagctcttgttggaggccattagccaaacaaacccagggagccagtttatgtatgttgtagacacaagaccaaagttgaatgccatggccaaccgagcagctgggaaggggtatgaaaatgaagacaactatgccaacattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatctggcatttccttgtgctcataatgagaatagttctccaattagccaagatgaacctcatggacatcaccaagatcttctccctcctgcagcccgacaaggaggaggaggacactgacacagaggagaagcaggctctcaatcaagcagtgtatgacaacgactcctatactttggaccagcttttgcgccaggagcgttacaaacgtttcatcaacagcaggagtggctggggtgttcctgggacacccttgcgcttggctgcttcttatggccacttgagctgtttgcaagtcctcttagcccatggtgctgatgttgacagcttggatgtcaaggcacagacgccacttttcactgctgtcagtcatggccatctggactgtgtacgtgtgcttttggaagctggtgcctctcctggtggtagcatctacaacaactgttctcccgtgctcacagctgcccgtgatggtgctgttgctatcctgcaggagctcctagaccatggtgcagaggccaacgtcaaagctaaactaccagtctgggcatcaaacatagcttcatgttctggccccctctatttggccgcagtctacgggcacctggactgtttccgcctgcttttgctccacggggcagaccctgactacaactgcactgaccagggcctattggctcgtgtcccaagaccccgcaccctccttgaaatctgcctccatcataattgtgagccagagtatatccagctgttaatcgattttggtgctaatatctaccttccatctctctcccttgacctgacctcacaagatgataaaggcattgcattgctgctacaggcccgagccactccacggtcacttctatcacaggtccgtttagtcgtccgcagagccttgtgccaggctggccagccacaagccatcaaccagctggatattcctcccatgttgattagctacctaaaacaccaactgtaatcttgcagtctccccaggaacttatgat

SEQ ID NO: 19347 - DNA, 7472 bp, Homo sapiens
gtcttccgagtttcgagacctgctgcttccgcccggagttgttgtgggctccagcagcgagtagccacttccgctaggagtccctagcggccagggcgtggaagcggattctgaggcggctttctcctactgccctccgcttgccaacgcgggacccggagcccaacggcagcggcggtccttgggcctgtggagaggggttctctgtggccgagtcctaggcctggtgaaccgcgcggtgcgggagaggcgcttgggcctcgtccagccccagcccctgtctccccgcggccggtgccggcggctgtaggcctcgccgcgcccacccagcctggggcgggcccagcctcaccgcccggcccgccccgccccacgggccagccccgcgccgggtgtttccgctacttccctgcggcggggtaaccgcctcgcacctaccgggctcggttccctggctccggccgcgggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaaaaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaactgcctgcctagcggctcagtgcatcgacagggaaggagcatcaatattgattcacggaacagaaggaactgattccacactccaggtgacctccttggcccagatcatcttagagccaagaagcaggaccattcgtggttttgaggccctgattgaaagagagtggctgcaggctggtcacccattccagcagcgctgtgcacagtcagcctactgtaacaccaagcagaagtgggaggctcctgtatttcttctcttcttggactgcgtgtggcagatccttcgtcagtttccctgttcttttgagtttaatgagaatttcctcatcatgctctttgagcatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaacaggtatggtcctccgatatttacattaagaagagttaaatttattttaacgtagacactaaaagtatgtgcaatatacaattaaagtaggaatttgttactgattgagaattgttactggtgaattggttttcaggttttgagcatacatatacaatgtgtttcaaatgctgcttgtaaaattaaaccatcatctagaatagagttaatttattataatcaagctacaaataggttttcttaaaccagagatgcactgcccttgtctaaagttcttattgcactggtttatatgtgtatgtgtgttttattgtgtgtttttttaatttgtaagtattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaaaggaaacagcctcacttttttgtgctccctcagaattgcttgctatgtctgttaatacagctgagctttttgttttcttctctttttgtctcaagattgtatatgaaggaggcttttcttctcagctaacaggcatataaggaaaaccatctagagagttttctttagaagtgactcccattagcctggtgtggtggtgtgtgcctatagtcccagccactaggaaagctgaggcagaaggatcccttgagcctaggaggttgaggctgcagtgagctatgatcgcatcagtccactccagcctgagcaacagagcgagaccctgtgtctaagtaaagaaaaagccagaagtgactcccactgcttctgttgatcggccatagggcttccatgggtggaaacttgtgagggagtttgtattaggtctggtcatggagggatgatgtaccatcaaggtagacccatcttcctgatgcacatttgctgtgcgagccagagtacagtcataacacggtattcgcatttcgttttctctgtctcactgagacaacaatctatactgttttggcaagtttgcattttagtattaatttataattagggattgttcaaacttcagatctgtttacaggttgtaaaaataaacttcggtatcagtgcatctacagaagtgttatttggtaatccaaatattagagttttcccaaatccaaaaacggtcagaaataagtccattatcaatataatttgaagaagatttttagtagtactgtgaagttcgtgcttacctggatgagaagaataaatgacacggatacactcctgagaagacactcgttaaacattgcatcggagagctgcctttgataaatgtgctgttaaacacttgaatgaagagaatggtggcagaatgagtgagcaagcagattgccccagaggggccggtaataatcacgtgagggataatcagattcctgcgtattcagcatcttctctattcatgtggagtgaaagctggtttttatacaggagatacgtaaagtaggccccacaaataatatttttaaaatacaaaggatcaccacaatcctctattgaacatataaggatcctcagatttaaataagtactttttttttttttaatcagaagaacattgttgtttgattatatgtttttaaaaacctgaagcttttttggtggcaggacctttcaataaatatttatttggtcaaaattttttattttgattttattaaatgggaagaaagcaagcagaaatagtaaaattcagtaggtttaaaacaatctataaatgtattttatttccaagaaaacttagggtctcaaagcaagattttaaagtgatttttgagaagacttgggggggacaataatagacattcatgtcagatcccatatgggggatttttaaacatttctttgaactttgaggcctgatttaggggtgggattttattgctttttgttttaaaggatgaaattttgtggggttttagtctttgattcagtcagtatttggtttatgttaaataaaaaatcagtatcatggaaaagatatgaccataatttagtctcctcaagtgaaaaacaggagtaatgtttcgttgcactttgaaagatctgcttcaaggcataactcgtgtagttgtctggtttcagggatagctgtttgaattgtcattctaaagtaggtcatcaggttcacttattatccgaccttaatctgggataaaggttttggtatttgcccacttctagatagaatgaatgaaaacaacacaagcgttttatgagcactctttatcagaaaggtatttcctggaccagaaatgggcaatagttacaatagttgatcctctgttctggaagctttgaaatttatcagagaatgaagtcattcagtacatctgataaagttttgttgttgttgttgttgttgttgttttaattgggcaaccctcagaactgaagaggttcagagaactttccaggtttatactatacctcaagaccacatagattagctactgcttattctttcacatgggctaggcctgttctcctcctccagacctagtattctaagttattaccacatagtatttttatgttacccatcatctttaaaaacattataggctgggcatggtggcttacgcctgtaatcccagcactttgggaggccaaggcgggcggatcatgaggtcaggagatcgagaccatcctggctaacacggtgaaaacccatgtctactaaaaatacaaaaaattagccaggtgtggtggcgggcgcctgtagtcccagctactcaggaggctgaggcaggagaatggtgtgaacccgggaggcagagcttgcagtgagccgagatcgcaccactgcactccagcctgggcgaaagggcaagactccatctcaaaaaaaaaaaaaaaaaaagactcatttatccatttacatttattctcagatgataaaatatatactgatactataactttcttatggtatcagttttctttattttcttgaataaaattacttctaccttcatttggtctttataatccactgtccacagcatcttcctttaaaccaatagtcccagaagagaccctctgaaattctaggactggatattaaaatgcctgaacctgttatctaaatcctttttaagaaacttaatgttccagctcttgaactacactgtggaacagtaatttgtgcccaatttagtggaagataatgaggctcactgtaaacactacattgtcctgcaaagtaattctgatgagagtttactgacttctagagccattctctttaaccgtctgcaggtctaaggattaactatatttgtgatttgtaataaaactgagttgtacaacactgcctgtgtttgtctggccaagacatttgcttcacttttaaaatgcacgttatctttggagaggtgaattattctacaaaatgcaccctaaatctcattgtttaaaaccttactgatctaataccatctacacaaaaaaatgttgtagttgcagaacttagtttataaaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcagaacttttgtaagtctgtgtaacattttaatattgtttgtaatattcactaggtgataatttcccctgtaccctataactgtaatcattcaccttgggttggccggtttgtcaagcttggtttactgaatcaagaaagagtcttgtcgaatgtggtactgttcttagtgtgtaatatttgcgtatggtgttcctctgcctcagaggacagttgcacagatggctagtgttaaatttctatagacgatggtaataaaatctgaatatatttaagtgctaa

SEQ ID NO: 19348 - DNA, 1541 bp, Homo sapiens
gtttctccctaagtgcttctttggatctcaggctctaggtgcaatgtgaaggggagtccctgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaa

SEQ ID NO: 19349 - DNA, 2597 bp, Homo sapiens
atatagccagttgatgtcagctgaatgccagtctcttcagaaaagctcagtccccagtttgagtcagagtagggaccatgctgtcccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatttaaagttccagattttgagctactattgctaacagatcccaggtttatgtcctttgtcaatcccctttctggcagacggtcctttaataggactcctaagggatggatatctgagaatattcctatagtgataacaaccgaacctacagatgataccactgtaccagaatcagaagacctatgaaaagaaagttgtatgtgccacataaaactctgaatataaaagttgctgttctactattttaactactggcaaagccacttgcatttttcattagtagcaacaatagcaatttagtgattttccttttctgacattcaatttcaatctcagatcaaatactaataaacaattagaaatcttactttaaaaaacttataactcacttgtcttcattcataattttgttttcacctggtttaaagaatccagatattttactgcaaaagttcagatggaaaagtaattgacagtttcacctttgtctcattttatatgatttattacagtgtaagtttttcaagtggaatctagaatcaaaatacagggagagatatgaagacctattcagagtttcatctggggatgaaagctatggaagatgatgtacaaatgttattgatggagaaaatggttgggtgtgtcctttctggtgaccatgagaaaataatatgtcttgatgaagtcttttcattagtcactcttagaattctaaagtgctttgcacttttcaatatgttttgaatcattaggtaatttattctggatgatattctccaaaattcaattcagttattatattcatttagcattaagtcaaggagactgagaatgactcaagggacgtcatagtaccatagttttaaggaccaaggtgtgcccagaattcaagtttcacaaatcccaatgctgtgcattgattatgttcaactttatgtgtgcattcttagaagagtaagaacaaataaagtacaccgtaatatacatataaatacattcatgtttgtgagagaaggaaagagtaagtaatttgaattggcagctttctttgctaaatctttaaattctgttaagatcctcaagtaactggggagtacatgctttaggacacaaacaaaaacaaagggcatgaaagtatctgaaagcaatgtagcacatatctatcgtaatatatgtaatatattgacataaaagacacaaactaatataaagttatagttatatcttaaaatataattgaagaagcatatgacatataacttatagaaatcagtatcaattcctcccatttcaattcagttaagacttctgtgatagatgtttatagcagagaagaaatgtctcatcaatagaaaactatcagataaagtttaggagataggaagaaggactgtgtgtagtaatgaaaataccaagttgcaacattacatgtttacaaaaaaaaatctgtgtttgtagtgtggaagttggtgactgttttaatcatcatctagacttgttaagtagaaaaattttaaaaatttgcttatgaaaatataacccccagaaagtaacaatgacaaagtattatatttatatatattattgtagagaatttgtatatttttaaagatgtcttaagatatcttaattttatttataagttttggtgtttacctgttttaaaatgataatgttggcatctgtgataaactatcaatgaggctcccatcatgccattttttgttcattttaatctttaaaaaataaaaattaggcatattaattatgca

SEQ ID NO: 19350 - DNA, 3445 bp, Homo sapiens
caggagagaagaaaggaaggaagaaaaggataagtcaagcaaagatattgaggagcaattcattcatccatctatctatccatccattccttccttcgacaaatatctgctgagttcctatcaagcaccattcttggcactaaggatataacagttaacaagcggaagctaccagcagctgaccctcaacatttccaggatgatccccaaggagcagaaggggccagtgatggctgccatgggggacctcactgaaccagtccctacgctggacctgggcaagaagctgagcgtgccccaggacctgatgatggaggagctgtcactacgcaacaacagagggtccctcctcttccagaagaggcagcgccgtgtgcagaagttcactttcgagttagcagccagccagcgggcgatgctggccggaagcgccaggaggaaggtgactggaacagcggagtcggggacggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggctatgcggagccgctgaagggcgtcccgccagagaagttcaaccacaccgccatctccaagggctaccgctgcccttggcaggagttcgtcagctaccgggactaccagagcgatggccgaagtcacacccccagccccaacgactaccgaaatttcaacaagaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccgaggagctgtagccctagcctgaatcttcagttccccagtctcgggggcctggtaacatccggagccaagacttgtggacagcacttcacagttgaagaagggccttcacacacaaaacctgattgcaaatggcttcagaggtcaccaagttcagtcgtcccaaaacatgggtgtgtttcaaaattacctggggatgttgttccaaatccagacaactggactgtcccagacttgcagcatcagagtctcctgagtcgaggaatctgtattattaatagcaaccagggccgggtgtcgtggctcacgcctgtcatcccagcactttgggaggccgaggcaggaggatcacctgaggtcaggagtttgagaccagtctggccaaaatagtggaaccccgtcgctactaaaaatacaaaaatgagtcggacatggtggtgcatgcctgtaatcccagctacttgggaggctgagacaggagaatcacttgaactaggaggcagaggttgcagtgagccgagattgcgccactgcaccccagcctggacaacagagtgagactccttctcaaaagtaaataaataaatagcaaccagtactccaggtgattccagcataacttatccatggtttgtgtcattaggagtccacatccacacctctgctctttcctgttcctgtagtgtacactcccccggtgacagggtgctcactggcaccccatcttcctgtgaataactcaaataattagaaaatgttccttttactgagatgcagttggtcttcatctattcatgctctaaacagttcctaagcgctgactgtgcgctagacactgccaggcccgggcctcgaggaggaaaagacagtagggaagacattatagagcatgaagtcaccataattttccctaaagcatgcttattgacaattgaggaacaaagtgttgtggagcagaagaaggagtccctcaccctaggtgtgagatgggattctggaagcttcctgaaggatttgagtgggaccttgtgggaggcgtgagagtccatgaagggggtgtgagggggagggtatttctggaaagtggaccagcatgtgcaaaaatatggaactgagcacgggtgcagggtgttctgcagaagggagaaggctgtgctagaggagccagtgagggccagcatggggtgggcttcactaaggaaatggggaaggttttagtgatgggtcttgctgggtgctgtgtggggcgcatattggagaagggtaatgccagaagccaggaagcctgcaagggatgaggccatgggaatggagagaaggggccacccactgggcacctaacaggacaggtgcaaagtggggtgcttattaagattccttctttccactccattttgagcaggctgcttaaagtggtggtgatgatgatgatgatgatggcagctttatatcgagtgcctcagtgcttgggctggtagtagtttctctacatatcttatttctaattctcagaacaaccctgagagaaagatattgttgtccccactttacagatgtggatatttaggccaaaaggaggaagtgacttgtccaggggcagacaccaaatgggaatctgattccagtggatgtctcttttcagtgcactgggtggtcaatgcccactcgctctgaaatcatctgactgtgatgccctgccttggagtttagaagttgagtgcaggcttgggagtcagactggatggggtaggttctaactctgccactgctagccggatgaacttgagcaagtcatttcacatctccgagcctctgtttctccaagtgtaagatgaggacaagtataaaacctcctttatgggtttgttgtgaacacagtgcagggcacatttataataagagctcagtcaatggtaggtttcatgcaactgctgctctaggctggaaaagttgttcttgcactggatgcagcatgagaagctggctgctaagatgtcactgggggtcactaaagctgaagcctgaaggaaagcctctcattgctgtagagctctccctgcctctctctctgggggcgatggggaaggtcaggagtccagcccattcccagggtgtgtgggatagcgattgcattttccttttgctctggagtttcactccccttctgggtcccaagggcccaatggcctgacttttagaattgcttgcaattggtgttttctcttgaatttgggggctgccatttaaagccaggtttccatgagctgaagaccagccattcaagaatctgaaaagtagacaagaggactccagttgcctcaggttggttctgctgtgctctggaaagtaactgcagccaccaggtatgaaaaggagcctggtggggagaccactgcacccaaaacaaatcctttcttcttctgagaatgtgactttttctggtgttgtaaaaaagaaaaaaaaaagaatgctcattgtaaaaataaaaaaataataataagcaa

SEQ ID NO: 19351 - DNA, 1451 bp, Homo sapiens
aagaaaggcaggagagaagaaaggaaggaagaaaaggataagtcaagcaaagatattgaggagcaattcattcatccatctatctatccatccattccttccttcgacaaatatctgctgagttcctatcaagcaccattcttggcactaaggatataacagttaacaagcggaagctaccagcagctgaccctcaacatttccaggtgactttggtgtgtgcatatgtgagtgtgtgtgtacacgtgggtgcaagccctctgtctgcacaggcctgttgccagggcacctgtcttccctagggtctggtgcttttagcctctggctccagctcctattgcagcccgaaataaggctgtgacccatggcaaggcaggaatgattctcatcagctgaagccagagctggctgcaggggacaccctgctcgctgcctactgactgctgaccgctgactgcctacagggacgccacgcaactctcagcttcccgacagaggtgttaatcttgagggtctaagattccctcctgcctattgtggtcccatcctctcaggatgatccccaaggagcagaaggggccagtgatggctgccatgggggacctcactgaaccagtccctacgctggacctgggcaagaagctgagcgtgccccaggacctgatgatggaggagctgtcactacgcaacaacagagggtccctcctcttccagaagaggcagcgccgtgtgcagaagttcactttcgagttagcagccagccagcgggcgatgctggccggaagcgccaggaggaaggtgactggaacagcggagtcggggacggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggctatgcggagccgctgaagggcgtcccgccagagaagttcaaccacaccgccatctccaagggctaccgctgcccttggcaggagttcgtcagctaccgggactaccagagcgatggccgaagtcacacccccagccccaacgactaccgaaatttcaacaagaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccgaggagctgtagccctagcctgaatcttcagttccccagtctcgggggcctggtaacatccggagccaagacttgtggacagcacttcacagttgaagaagggccttcacacacaaaacctgattgcaaatggcttcagaggtcaccaagtt

SEQ ID NO: 19352 - DNA, 2850 bp, Homo sapiens
tgagtttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 19353 - DNA, 3470 bp, Homo sapiens
agtctgaagtcatgcaatttgacttttcctttctggaaaccagcgagcagaaatgaaaccgaaactgaattgtccgggaaattcgcggtgggggcggagagcgcagggagaagtaagcccagtgcaggatcctgaggcccgtgtttgcaggaccagggccggccttccgattccccattcattccagaagcaccgaaccacgctgtgcccggatcccaagtgcagcggcacccagcgtgggcctggggttgccggttgacccggtcctcagcctggtagcagaggccaggccagtgccacaaggcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 19354 - DNA, 887 bp, Homo sapiens
gacgggcaggagacagatgccttcctcttgtctcaactgcaagaggcacctaagtccacctgggcctggagcaggacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagaggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctg

SEQ ID NO: 19355 - DNA, 872 bp, Homo sapiens
gcggggtgaaagaggcgaagcgagagcggaggccgcactccagcactgcgcagggaccggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactca

SEQ ID NO: 19356 - DNA, 516 bp, Homo sapiens
atctgattcagcaggcctgggttcgggcccgagaacctgcgtctcccgcgagttcccgcgaggcaagtgctgcaggtgcggggccaggagctaggtttcgtttctgcgcccggagccgccctcagcacaggccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgc

SEQ ID NO: 19357 - DNA, 905 bp, Homo sapiens
tcttcgcggcgcggggcggggctgggcgcggggtgaaagaggcgaagcgagagcggaggccgcactccagcactgcgcagggaccggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagaggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataag

SEQ ID NO: 19358 - DNA, 281 bp, Homo sapiens
cccagaagactggtactcctgagaggcagatgaagtggtggtctttgatatcgagcctgggatgccctgggcacatgaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcg

SEQ ID NO: 19359 - DNA, 583 bp, Homo sapiens
actccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagaggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcgggga

SEQ ID NO: 19360 - DNA, 2663 bp, Homo sapiens
tttcttcgcggcgcggggcggggctgggcgcggggtgaaagaggcgaagcgagagcggaggccgcactccagcactgcgcagggaccggaattctgtggccacactgcgaggagatcggttctgggtcggaggctacaggaagactcccactccctgaaatctggagtgaagaacgccgccatccagccaccattccaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcag

SEQ ID NO: 19361 - DNA, 3042 bp, Homo sapiens
atttctctccctgtttgttgatgacggagcaggggagggagtggttcatatgccacataaaagtgaagtggaggaaagggaagagatgatttctccatcctgaacgtgcagcgagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgta

SEQ ID NO: 19362 - DNA, 843 bp, Homo sapiens
agaccttcaagttaattgttggaacctgcggctctaacacttccagcaaagctacttctgtgaaagctgtgacgagcagaggaaatgggacaggagaggagctgaatcctgagattgtatcgctaggagcccccaaagtacgatgacggtcctcgggccagcatgggggtgcattggcaccatgtaaggaaaggggccctcccgtggcaccgttggagtggggcggtgtggggttgttcggagagaaaagtttcccatgagctctgtttcagcaaacggcgatgaccacttccgtggcaactaaacagtcttgccttcctgcacgtggacatttttcttcatgcatatttctcttgcaaatggttctattgtttgtataacagtatttcatgagcggagaagagttggaagcaaaaatctgttcatgagaaatcctttattaagctcctactgtatgccaggtactttgggctgcaggtacagctgtgaaaaaaaacagcaggcgggaaccagccctgggacaggctccacacactcactgagcaccgcctcctgcacagcgcagtccctgctctcagcctgagcaggcgcagcagccctgccctcccaagaaaggggatggtgagaagcctagtgtcccctccacagagaccagcgccacacatgacagccacacatgacagtgttggtaccagcactcagtctttgagccacaagtgcttataagatagcttgtcaggaagatcggaggtgccaagtagcagagaaagcatcccccagctctgacagggagacagcacatgtctaaggcccacaagccttggccctaccggaggagaagtc

SEQ ID NO: 19363 - DNA, 604 bp, Homo sapiens
taaacagtcttgccttcctgcacgtggacatttttcttcatgcatatttctcttgcaaatggttctattgtttgtataacagtatttcatgagcggagaagagttggaagcaaaaatctgttcatgagaaatagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgt

SEQ ID NO: 19364 - DNA, 618 bp, Homo sapiens
gaagtggaggaaagggaagagatgatttctccatcctgaacgtgcagcgggtcttcctgctctgtttcccaggctggagtgcaatggtaccatcatagctcactgcagccttaaacttccgggctcaagtgatcctcctgcctcggcctcccaatgcattgggattacagagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcgggga

SEQ ID NO: 19365 - DNA, 582 bp, Homo sapiens
ataaaagtgaagtggaggaaagggaagagatgatttctccatcctgaacgtgcagcgcctttattaagctcctactgtatgccaggtactttgggctgcaggtacagctgtgaaaaaaaacagagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgg

SEQ ID NO: 19366 - DNA, 1257 bp, Homo sapiens
aaagctggatggtcgtccgtcccaccatggcgggtgggtaaaggttcttttcctgggctgtgtcattccacccagagcaagggataagcctgtgatagccgtaaatccggaaccactaccaaggtgaaagaccttcaagttaattgttggaacctgcggctctaacacttccagcaaagctacttctgtgaaagctgtgacgagcagaggaaatgggacaggagaggagctgaatcctgagattgtatcgctaggagcccccaaaagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcgcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcaggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccaga

SEQ ID NO: 19367 - DNA, 837 bp, Homo sapiens
agcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagaggatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggg

SEQ ID NO: 19368 - DNA, 1772 bp, Homo sapiens
cgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactaca

SEQ ID NO: 19369 - DNA, 824 bp, Homo sapiens
cccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggc

SEQ ID NO: 19370 - DNA, 2522 bp, Homo sapiens
tccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattgg

SEQ ID NO: 19371 - DNA, 2601 bp, Homo sapiens
gtagagtcttagggtgaccccagggggacgtaatgtttccgagaagaaggacagaaagaagactgggagacaccggaactcgaaagaaaatcggtaacaaaatcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattgga

SEQ ID NO: 19372 - DNA, 2647 bp, Homo sapiens
ttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtc

SEQ ID NO: 19373 - DNA, 954 bp, Homo sapiens
acataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcatagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccgtccccagggctgacccagtgtggctgcattcactggga

SEQ ID NO: 19374 - DNA, 1149 bp, Homo sapiens
gcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcgcatacagaaaggctgtacctggaggaaggaagtgcggagccagcctgagttgggagaagagctccagagagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccgtccccagggctgacccagtgtggctgcattcact

SEQ ID NO: 19375 - DNA, 2493 bp, Homo sapiens
tgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgcgctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctct

SEQ ID NO: 19376 - DNA, 2589 bp, Homo sapiens
cggagccatgggcaagtgcagcgggcgctgcacgctggtcgccttctgctgcctgcagctggtggctgcgctggagcggcagatctttgacttcctgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgcgctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctcta

SEQ ID NO: 19377 - DNA, 1446 bp, Homo sapiens
tgggctaccagtgggctcccatcctagccaacttcctgcacatcatggcagtcatcctgggcatctttggcaccgtgcagtaccgctcccggtacctcatcctggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgcgctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggcccca

SEQ ID NO: 19378 - DNA, 1106 bp, Homo sapiens
gtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaaagtgtggcctttttgctttttcctcattaatgcgacttttaacaggaaatcctcaggttaaactaaaccatcctctggacttagtgtgctgattttcttcgacaattagtaaataccctttgttatcatcagcattttacataggaaatccaatcagtcaagatgtgattacgtgacttttggtagacttttccaaggattctgaagggatgatcagagatttttttcataacgttctacagtactcaaaattataagatttccataagtgttttctcttttagtgcttcttttggctgtgctgctagccctgggatttctctttttcatttgccctatctccttcttccttcctagatttctcccaggcaccatccatcacctttaatctcccactttttttccagaaaaaatcacattttctatagattctaattctaagacattcatgcccccatttttcatagtactgtaacaat

SEQ ID NO: 19379 - DNA, 3115 bp, Homo sapiens
gtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatacttaagtttctgagccatccct

SEQ ID NO: 19380 - DNA, 3052 bp, Homo sapiens
cttatttgtccctctggtatatttacaggtactgaagatggatggggatcattaggtttctcttattatattgtcccacaaatatcttaaccgtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcatttt

SEQ ID NO: 19381 - DNA, 576 bp, Homo sapiens
atgaaaatagtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtaa

SEQ ID NO: 19382 - DNA, 420 bp, Homo sapiens
atgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaagctggcaggtttcatctacgcctgttatgttgtgaaatgtataactgaagaagaggacagctttgatttcataggtggctttgactcttatggctatcaagggcctcagaagacatctcatttacaactacagcctatgtacatgtaa

SEQ ID NO: 19383 - DNA, 594 bp, Homo sapiens
atgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctttggtgggttttgtgtatgcctgttatgtgatcagtatttccatggaagaagaagacacatattcatgtgatctgcaagtatgcaaacatctttttatccagatgctgcaaattattgaataa

SEQ ID NO: 19384 - DNA, 1988 bp, Homo sapiens
agccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctttggtgggttttgtgtatgcctgttatgtgatcagtatttccatggaagaagaagacacatattcatgtgatctgcaagtatgcaaacatctttttatccagatgctgcaaattattgaataagcaagaattagtaagatattatcaccaaattgtcacatcagtcaagcctcatgtgcttcctaagaactgaggtgatgcattattttagagtgtcattctaaaccccagattcaacatcttcctaatctttctagtgcagtctaatatataaattttatgaaaagcataggtttttttttaaccagcagtgctctttgagaatttacattgattcctaaagattgccattgctttgtataaaatgttataaattatcttagcatcttacctggaatttccactaaattcaccaatttatgatttgtgaaatctgattttactttttgaaaattttcatgtgaatttcccattttcagtgttgtagcacctctctcttcctctaagatcctgcaagctcatcaaaagccatgatcttattataccagcagttttatttattcaatctttcaacaagtagttattgaacttctataatgtgccaggctctggagctcgccttacaccaaacagacacaatcgatccattcgaagtgtcgtaattacacattgagggaccaactagaccttttctcattgtaaacttggagcaaaagtaaattcattaaaataaatttacattatagtgccacaaaaaaatgaacagaaccagaaagcattttttacaaaaattaacagaacagtgtgatagaggggaaaaggatgtgagatcatggtgccctaccttcaatagggtggccagaaaacacctctctgaagaagcagcatttgagctgagacctgaagaacgaggagtcagtgatgcagagaacctcaggagatgccttccaatctgagaaaagaggtgtacaagcaacatggtgccggcacctgctcagcttttggaaaggactcaggaagcttttactcatgatggaaggcaaagcgggaggaggcacatcacatagcaagagtggaagcaagagagacgtcatgctcttttaagcaatcagctctcaggtgaactaatagagtgagaactcactcatttctgtggggagggcatcaagctatttataatggatccatcctcatgacacaaacactgctatctcccacctctaacactggagatgacacttgaacatgagatttggaggggacaaatatcaaaactatatcatatggtttgcagatattttcttccatccttgagttatcttttcattttgttaattgtttcctttgctgtgctgaagctttgtttaatgaaatcccatttgtct

SEQ ID NO: 19385 - DNA, 1114 bp, Homo sapiens
acacacacacacccggacccagacagcccactccactttccagacgcccacctcctacatactcccctcccctaaacagacattcacccactcgccatctgtagcctccttccaaccccccgccccgcccgcctggctccccctccccaagaaacagacctgcacagtgggacgcagggacccccgccagacgctcgggtcgtgcgcaccgcactgacctcggcccgccccgccgggaaactaacaaaggcgggcgcgagccccgagccctggagccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtgtcatgggtatttgataggcagatctttctcctcagtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctatatttttcctataggtttctgctgtggagccgtactcactgcagaccctgaaggaggaggaatacctgctttctgcccctcagtggtctcagctgccgttcttctcacatatgcatcatccatacacatcaagatgttttgcggctttatgtcagtatgagtaatcttggtcttactgtgtagatattctaacccttgaaggaaatgtcaaatgatactcttcagacaacgtactgg

SEQ ID NO: 19386 - DNA, 1430 bp, Homo sapiens
gggtccaggctgcggcgcgtggggagcgggcggagcgggggcgggggccgagcgcggggcacccgggggcctcctgtataggcgggcaccatgggctcctgctccggccgctgcgcgctcgtcgtcctctgcgcttttcagctggtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctca

SEQ ID NO: 19387 - DNA, 730 bp, Homo sapiens
aaaacctgaaattttgtggcacagcacctggtgagactgtgggtttgacaaatatctcaccactttatcatcaagttaaacattattcttttttattaaagcttaataattaaagcttaattctgcaagtgaaatttatatatactgctttattagtacatatatgacactttgttttcaaacattgccataacctgtttgaaggaacttgagcttcagggttacaaaactgcttctgctatgatggagaagaggaggaaaaaatgcttagataagagcaatttaacttaaatggaggaagtgtgtctatattgacaaaagtccaaagacttgttgagccagctaactgggctttttacaatggcttttcaagattgcagatgccgcctacagagacgacagtcatatttgagccccgaagctcgcgaatgtagcaggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaaccc

SEQ ID NO: 19388 - DNA, 3600 bp, Homo sapiens
agttgcccgccaacaggaagaatgtctcctccctctgcagggcttcctttcccccatcgagggcccctggggaccacaggtccccagcgggtagggcggaggcgtggccttgcgaaggtcagcggaggccacccagagctcacagcctcctgccagcgcgctctctgtttctctgcagccccgaagctcgcgaatgtagcaggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacgctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggcaattatactctcagagttgactgtactccccttctttaccaattagtgtataaactgacaaaagagatccccagccctgatgatgggtttgagagtaaatcactgtatgaaagctggttggaaaaagacccttcacctgaaaataaaaatttgcctagaatcaataagctgggatctggaagtgactttgaagcttattttcagagacttggaattgcttcaggcagagcccgttacactaagaataagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattgacagaccatggagtatcatttgactccttattttctgctgtgaaaaacttctcagaggctgcttcagattttcataaacgacttatacaagttgatcttaacaatcccattgcagtgagaatgatgaatgaccaactgatgctcctggaaagagcattcatcgatcctcttggtttaccaggaaagctgttctataggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatgtataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaacgtgattataaaaaacaagtctgcaaggaaaccagaatcatataccttctcttgtgaaatcaccatgaagtgtgaatggtcaggaaaaagccagtaatattcatacatttaataatttcagctctactgaataaacatataagtctgatgggtgatgaaaatagctactacaatcttcatattctaactcctataaagactgtatatcagaatctgcaaacttttatgcagatcccagtgactcaattacatgttcaactatgattaaagcttcaataaacttggttgttcatctacttca

SEQ ID NO: 19389 - DNA, 2594 bp, Homo sapiens
gccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtacc

SEQ ID NO: 19390 - DNA, 2512 bp, Homo sapiens
gccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtacc

SEQ ID NO: 19391 - DNA, 2699 bp, Homo sapiens
ctaccccagctggccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaa

SEQ ID NO: 19392 - DNA, 2271 bp, Homo sapiens
gccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcgggctccgtagtcacattccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactcc

SEQ ID NO: 19393 - DNA, 716 bp, Homo sapiens
acctcagggtcattagaaagccaccacagatctaggcatctaagcaggaataggagaggaaaggcaactgtagccacattaatcacttttatcaggaagataaatgcttttcccgaatctttcaacaggctttcattttacattgggcatatttttgtcatatagccttccctagctgcaagggaggcttttcaaacttctttatggaattcagcaagaaagtaaagaggataaaatgaagcacactggatgaatggtgtggcttgatgaaattaagaaatttggtacaactatataaaaatgaagatgacatggaaatttcaaagaagattaagactcagtggacctctttgggcctagaagatgtacagtttgtaaattactctgtgctgcttgatctgccaggcccttctcccagcactgtgactctgagcagcagtggtcaatgctttcatcctaatggccagccttgcagtgaagaagccagaaaagatagcagccaagacctgctctattcatatgcagcctattctgccaaaggaactctcaaggctgaagtcatcgatgtgagttatggaatggcagatgatttaaaaaggattaggaaaataaaaaacgtaacaaatcagatcgcactcctgaaattaggaaaattgccactgctttataagatgaaagttttagacaaagccgatcaaacctcacctctctattag

SEQ ID NO: 19394 - DNA, 4953 bp, Homo sapiens
ttattcacagaagaaagcaggtagtatactgttacaatactacagtagaaagtcagaaggtcacaaagcttgcagggtaagtgacacaacttgaaactgcttggccctctttaaaaagaaataataaaatgggagagaatgaagcaagtttacctaacacgtctttgcaaggtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctagacggtgctgagaatcagaacctagggcattcagagactatagacctcaatcttgattccattcaaccagcaacttcacccaaaggaaggttccagagacttcaagaagaatctgactacattacccattatacacgatctgcaccaaagagcaatcgctgcaacttttgccacgtcttaaaaatactttgcacagccaccattttatttatttttgggattttgataggttattatgtacatacaaattgcccttcagatgctccatcttcaggaacagttgatcctcagttatatcaagagattctcaagacaatccaggcagaagatattaagaagtctttcagaaatttggtacaactatataaaaatgaagatgacatggaaatttcaaagaagattaagactcagtggacctctttgggcctagaagatgtacagtttgtaaattactctgtgctgcttgatctgccaggcccttctcccagcactgtgactctgagcagcagtggtcaatgctttcatcctaatggccagccttgcagtgaagaagccagaaaagatagcagccaagacctgctctattcatatgcagcctattctgccaaaggaactctcaaggctgaagtcatcgatgtgagttatggaatggcagatgatttaaaaaggattaggaaaataaaaaacgtaacaaatcagatcgcactcctgaaattaggaaaattgccactgctttataagctttcctcattggaaaaggctggatttggaggtgttcttctgtatatcgatccttgtgatttgccaaagactgtgaatcctagccatgataccttcatggtgtcactgaatccaggaggagacccttctacgcctggttacccaagtgtcgatgaaagttttagacaaagccgatcaaacctcacctctctattagtgcagcccatctctgcacccctcgttgcaaaactgatctcttcgccaaaagctagaaccaaaaatgaagcgtgtagctctctagagcttccaaataatgaaataagagtcgtcagcatgcaagttcagacagtcacaaaattgaaaacagttactaatgttgttggatttgtaatgggcttgacatctccagaccggtatatcatagttggcagccatcatcacactgcacacagttataatggacaagaatgggccagtagtactgcaataatcacagcgtttatccgtgccttgatgtcaaaagttaagagagggtggagaccagaccgaactattgttttctgttcttggggaggaacagcttttggcaatattggctcatatgaatggggagaggatttcaagaaggttcttcagaaaaatgttgtggcttatattagcctccacagtcccataagggggaactctagtctgtatcctgtagcatcaccatctcttcagcaactggtagtagagaaaaataatttcaactgtaccagaagagcccagtgcccagaaaccaatatcagttctatacagatacaaggtgatgctgattatttcatcaaccatcttggagttcccatcgtgcagtttgcttacgaggacatcaaaacattagagggtccaagttttctctccgaggcccgtttttctacacgagcaacaaaaattgaagaaatggatccctctttcaaccttcatgaaaccattactaagctctcaggagaagtgattttgcaaattgccaacgaacctgttctgccctttaatgcacttgatatagctttagaagttcaaaacaaccttaaaggtgatcaacccaacactcatcaactgttagccatggcgttacgcctgcgggagagtgctgaactttttcagtctgatgagatgcgacctgctaatgatcccaaggagagagcacccatccgcatccggatgctgaatgacattctccaagacatggagaaaagctttctggtaaagcaggcaccaccaggtttttatagaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatataaaaatatgtactattttaaggaaaaatttccaagaagttctggactatctttgttcctatggggagggcatataggaacacagtttattctctctgatagagctattaatgacttagtttctgtaaaagaaatggagagttgatatggttcagattaacttcactattaagtgttcaatatgaagaattcaagtattctgactgagtgattggttgacctaaaccactttgaatgtttctattttatgaaatgaagtttctcttcttaacacaactagatgtagtaatacactggttatgaaattgtatttttttaagtattaatgaaaaaagagccataagcattccaggagaaaatctcaagggagctacatagagcaatttaaatgcaaatttttttcctaacaacttacaaggtgactagctttgaaacccctaatttgcctcagttgattttctaagaatttcaggagtgatgtatgtcttaagagggagaaaaaaatatttcttattactttttctcttgtttctgttggaaacactgaagcagggactctaaaatgaaagcatctcacattggttttctttcttgtatcttttctgaaactccttgctgtaaggcagctttctcagagtactatatattttcaacagtaaagtagcagagtttctctttgaaacccaaaatgtcttctaaagaatcaaatttctatttctgcctctgacaaaaagaacttactatgaaagaaatagttgttttatcaataaaagccccttaatattatgaagaaacttttcatattttttcttctttatccttaattgtgactaagatggaaatctagaaaatattcatgcttctaagtttctgcagtgttactgtaagagagtgtctcgtctacacttcagttcttctctcatgtggaaaactaagctttttatattgacattgccattgaatagctctagcaactattattattcccccaaaccctaaaattctacctattaggtgtcaggttaaagttctaatttatctttagaaatttatgtgaaaaatggttttcctatactggataaagcaattccccttaggaaacatagcctcagagtatttcatataaattttctctatctaattcaaacatatctccccatgatacaccgccagagtgacattgcagacagtctgtgtatgtttaaattttcactttttatggatgagcataaacctagtcttagtttaaaggcaaactaaagttgaggggaaataattaatcaatactgattaattgatttataaggttcaacactgtctaccctaaataatttttatatgctcaaggcaaagcagggaatagaggcaattagctagataattcaagcagaaatccattttcatcgaaattgcctgtgtgcacatatttttagatgaaaaatgaaactaccttacaatattatttttttaaccaatgtatttgtttgcaaacatttgccatgttgaagagtgtgtataggaaaggtctagaaataaataggcttgtgcatacctaggcattcatgctctttcttcctcttcagagatcatcagaaaagaggtgggaatacacaagcaggtgcatgtaagcccaaaagctagaaagccttatatttaaccaaaggttgatgtgttcattccagttattcacttacagatgaaactaaaacaaataaaggcaagctattatcagtttggtagttcattattttagaacaaatttctaaattaatttattcccataacctacaatagcactgagaacagaaaacatgtttcttcttcattttgtttaaagattgcgtacctaggtaagtcacactgtatagataaaaaccttcttctgtattcctcacctctaaattatatgttatttgctatttgaaaactgtagttaactatggttttttattagtctattaaaagatacgtggagatattaaattatacctaaagcagacgtccaacaaattctgtacatgctgctttacatctttgcaacaaacctcttaactagcagcattatttctatagtgtgattacctgagggtgcctccaaatgtatatcatttcactcccctcccctccccacccccaatagattcaaataaataaaatcctgagcaaattaa

SEQ ID NO: 19395 - DNA, 3694 bp, Homo sapiens
ctggaacgcttcggacttatcaggttaccggattcgagtcagaagcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactgaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccggatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtatagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattatttttttttttcagttaaatacagacttgtttggacgcaaggtaccctttctctttttaaaaactttttatcatgaaaactttcaaatacaaaaataaaatggtagagtgaacctccatgtacccagcatccagctccagtaaccat

SEQ ID NO: 19396 - DNA, 1869 bp, Homo sapiens
gccccgccctcactggaacgcttcggacttatcaggttaccggattcgagtcagaagcggcggcaggtctgaacgcttcgcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccggatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttg

SEQ ID NO: 19397 - DNA, 1856 bp, Homo sapiens
ctggaacgcttcggacttatcaggttaccggattcgagtcagaagcggcggcaggtctgaacgcttcgagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccggatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccc

SEQ ID NO: 19398 - DNA, 1801 bp, Homo sapiens
gcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaattggactgcattatcaaacacatgtgctatgtacatcctcagtgcacctgccagcagatatcctggagggctcatgagtgaatttagtccaagatttaaagccctgcccccaggtgctcagcctgtgatctgtatccactcagcatgcacttgggcagatgatttgtctgtgtgctacccttccccccatattaccatacatatgcactgtgtggctgccagttaat

SEQ ID NO: 19399 - DNA, 1778 bp, Homo sapiens
actgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaattggactgcattatcaaacacatgtgctatgtacatcctcagtgcacctgccagcagatatcctggagggctcatgagtgaatttagtccaagatttaaagccctgcccccaggtgctcagcctgtgatctgtatccactcagcatgcacttgggcagatgatttgtctgtgtgctacccttccccccatattaccatacatatgcactgtgtggctgccagttaat

SEQ ID NO: 19400 - DNA, 2202 bp, Homo sapiens
acccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttttgtcatcctgctgccaagaagttttttaatcacttgaataaattgatataataaaaggagccaccaggtggtgtgtggattctgaa

SEQ ID NO: 19401 - DNA, 2073 bp, Homo sapiens
gacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttttgtcatcctgctgccaagaagttttttaatcacttgaataaattgatataataaaagg

SEQ ID NO: 19402 - DNA, 2780 bp, Homo sapiens
agtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactctttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattacccccgctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccactt

SEQ ID NO: 19403 - DNA, 2206 bp, Homo sapiens
gcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactctttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattacccccgctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccactt

SEQ ID NO: 19404 - DNA, 1530 bp, Homo sapiens
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatt

SEQ ID NO: 19405 - DNA, 352 bp, Homo sapiens
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtcaaaccatcataagttggggaccatccgcacaacccaaagtagacggagtagctttagaagacagctgaaggcctggcacagtggctcacacctgtaa

SEQ ID NO: 19406 - DNA, 873 bp, Homo sapiens
gcggctgcacggacaagagcggaggcctggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtgagtggctgcatgaggataaaaatgccctttggcaacagctgtattcagtgagcctcttccccagaggatacgccctccctgcttcctggtcagagccggggcttgaggtcagctggtgggaagatgagcagggcccccgggatcctggcttcttggagaagagccccctccctttctgtgcagaagggcagccaaactgctagacacacctgccacccagaggttccgctgggaaactgcttcttacctgtctacaaggccagtcccctcacagttacccgtctttgggctgaaaggctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcatctc

SEQ ID NO: 19407 - DNA, 745 bp, Homo sapiens
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagttttgtatccagagatttatcaactttgttgtcaaactagaaaactcaaaactcaaagtttcaaagaaccaaaggactcttcctctgggcaccacaaacttccccttcctccactga

SEQ ID NO: 19408 - DNA, 2231 bp, Homo sapiens
acttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaa

SEQ ID NO: 19409 - DNA, 2418 bp, Homo sapiens
gcggctgcacggacaagagcggaggcctggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtgagtggctgcatgaggataaaaatgccctttggcaacagctgtattcagtgagcctcttccccagaggatacgccctccctgcttcctggtcagagccggggcttgaggtcagctggtgggaagatgagcagggcccccgggatcctggcttcttggagaagagccccctccctttctgtgcagaagggcagccaaactgctagacacacctgccacccagaggttccgctgggaaactgcttcttacctgtctacaaggccagtcccctcacagttacccgtctttgggctgaaaggctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttga

SEQ ID NO: 19410 - DNA, 1536 bp, Homo sapiens
gggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagttttgtatccagagatttatcaactttgttgtcaaactagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 19411 - DNA, 1389 bp, Homo sapiens
gcggctgcacggacaagagcggaggcctggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaaaagggcagccaaactgctagacacacctgccacccagaggttccgctgggaaactgcttcttacctgtctacaaggccagtcccctcacagttacccgtctttgggctgaaaggctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagacaactgttgagtgctctggtgatgggagcaactggagcagtgggcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtca

SEQ ID NO: 19412 - DNA, 3964 bp, Homo sapiens
ggcgccgacacacgtttccagggctcttgagagaccataccctgggagtctcgcgggatctcacttttctcggcggcgcagggaatgagacagatcgcgggaattccacccgcgccgggagatggtctggtgacttcgcggctcctcccacgtctctctgggcagtccgccttgcgcatgcgcaggcggcggtggcaaggctacggttcgcgccagcggccggcgctatggggctgagccgcgtgcgggcggttttctttgacttggacaacactctcatcgacacggccggggcgagcaggagaggcatgttggaggtgataaaactcttacaatcaaaataccattataaagaagaggctgaaatcatctgtgataaagttcaagttaaactcagcaaggaatgttttcatccttacaatacatgcattactgatttaaggacttcacattgggaagaagcaatccaggaaacaaaaggtggtgcagccaatagaaaattggctgaagaatgttatttcctttggaaatctacacgtttacagcatatgacactagcagaagacgtcaaagccatgcttactgaacttcgaaaggaggtccgcctacttctattaacgaatggggacagacagacccagagggagaagattgaggcttgtgcctgtcagtcctattttgacgctgttgttgtaggtggagagcagagagaggagaaaccagcaccgtccatattttattactgctgcaatcttctcggagtacaacctggggactgtgtgatggtcggtgacacattagaaaccgacatccaaggaggcctcaatgcaggattgaaagcaacagtctggatcaataaaaatggaatagtgccactgaagtcctccccagttccgcattacatggtttcttctgtgctagagttacctgctctcttacaaagtatagactgcaaagtcagtatgtccacttaaagcacataaaagggcatgattatgaatgttagaatcaatttgctgagtatgaaataagaaaagttagggcactccacttatgataatccagctctaagaataattttacttatgatttaatggccaatattttgaaggtcttcccaaccctattgcttctaagttgtaacaaccaaccattgagtggtacttatatctgaaaattcagattgcatgaattcaggtcagtagtatagcccagaaaatttaaggaaatatattatttgttagtctgtatctggagctttttaaaattatgttattaatcttttagtatcttggctgcataatgccaagcaggattgctttacacatggatgcacaaatgtaaggtttatcttctggcttaaaaatagatatttttaaaaaatagattttctaaaacacagatttatgaaagcaagtgaatctggttaatatgaaataagtactaagtcacatgcaaatcaaggtattatatagtgaaattattttgcatattttgaaaacataaaccatagtttttgcctactttggatgtatactttcttttatgaacctgatttttctgtatgacatttttttttttttcagagggcagggagcaatttttctatggcatgtgacagattcctccagttagaaaaagctgttaaaatcaacacatggtgctcctttaccgtgacattttctcacctgtgcacagtgagccggtagcttccttttagtcttcacctctcaaggaaatgtttttactgtcttttcccagacacacagtggggttgagggagctaggctgttttgctagagataattgcaaggcacgtggcactaaaagtcatttttcttctgtggatccataagaggaacatttcctcagtgtagcctaacaatgcagcccccaatctgttcctttttttttttgaaatgggatctctgtcgcccaggttggagtgccatggcaccatctcggctcactgcaacctctgcctcctgagctcaagtgatcctcccacctcagcctcccaagggtgtgtgtgactacaagtacacactaccacgcccagctaatgtgtgtttttgtagagatgggattttgccatgttgcccaggctggtctcgaattcctggattcaagtgatcctcccacctcagcctcctaaagtcctaggattataggcatgagccactgtgcctggccccctcatctgatagaaaattagattttgctatgagccatttcctgagggccaatttaatactcgtgtgactcttcttagagttaccatctgccttaaatttcctctgtttttcacattcttggaaatatatcattgttttgcaaatttctatatctaattcagggtttaccaggagcttaataattaatggctacatagcaaggcatcgtcttggaaccggagaattttctctagactattaggctagacagtctcatgattatactaaccaaacctggagtaaagtggttgaaaaaaaagaaagtataaaggggcttattaaagtggttaataaatatgatttaggttggtttttgatatgtttttcttccaactgttatataagaaactactaatgtaaaatagtaggctatatgttgggatgtgtatagctatgtcttcaagactaatactcagagaatcaaattgtagattgtacctatctgtgagcctatttctttagccagttttctgtctactgccaagaaacagaattctctgcctcatgcaaatgccctttcgtgtttacttttcgctctagatttttaaaaatgtgattgtgcccttgactgtaccaaagtgctgttgctataacagtgaacatttgtgaacagaggatgtttgtagtttcaaatgcagtacccatatgaccttgatcatattttagctatttaaaaattaagttggaggattttggcagaagtagtcacatgcatgattgctctgatagattggttggcgtgtgctgcagggggcttgtccttttaactctcccacaggatggatgtaggcagtgtcacattcattatgctgagagtgaaggttcatcactcctgtatcatggtagcaaatctcaacaggatagcttctaggatgttaagtgagcagttctccagcagaaatgatgtagaaggaaaaaattgaataattaaatttccttgtcttcacagtttgtattctacagagtacagtaatgtattacattccatttgcacccttccttagggaagaactttgtggttatctaccttctgagtggaatgttacagaaaatattttaaaatattggaataaacctatgattttattaatattttttgttttagaataatattccttaaaattatgggtgatgttttgtcatctttattttttttcaaagtttccctgtagtggccttctcacacaaagccagaggccctccctaacactgcttacagaggtgggcctagaacagacatgaatggacactgcacctggaataccagcacctggtggggaggtttggttccatgtgcacctccacatacaaggcacgaacatctcagatctgggagtgcccaggacccagtggatgctcagtattgtaggaaagcaggtctttaccaaagttcttggtttattgctttcaaacttctttgcaaccttcagtaagaaacattttctatcataacctctttaacacatttatagtgttagataacactgtaactatatataaatataaatataacacatgtatataaataaatataaatataacattttatagtataacattaatatgtgtatgggatccagttttatatgtttaattttcataaaacattcttgttacgtgtgatgatatttttcattccattcttttttgaattagggaatatattcattgttgaacaagtactacttgtagtacacaagtcaaaaaaataaaagggtgaatggtgaaaa

SEQ ID NO: 19413 - DNA, 1170 bp, Homo sapiens
agagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctctg

SEQ ID NO: 19414 - DNA, 715 bp, Homo sapiens
tttttctacttgtatgttattccttgcctgtcataacaacagtgtttttggacaatggtgaaaaggagctccctctttgatttttgtagatggcagttgaattcctgcatgaactgaatgttccatttttcaaagttggatctggagacactaataattttccttatctggaaaagacagccaaaaaaggggctggcacagtgttttaagagatgtctgtggagttcagttgaatgatgagaccagcagttgggatgtgttggggagagtcagaacctctaaagagaaagtgctgatggtgttggtgctggattactcaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctg

SEQ ID NO: 19415 - DNA, 1378 bp, Homo sapiens
gaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaaggtgtgtcctgccggactctactcggttctgctgccgtgtgtggaaaaaggataggctggcctgagagggatggtcaggaccagccctccctgagccaggctgatgaaatgatcagtgaatgtgctcccacccgtgtcagcttcttcaggcttctcttcagtaatgcatgtcactctggcctgtagcagcagcaggagacacatgttatctaactttagcagtttctctggccacctagggtcacattagagtcttccactaattctctgaagcccatggccccagtactcctagactccagaatatgtaacaggagtgaggccctggaataagtcaagtctgggctcccttggagcaggtaagccctgagaaacatttaggcacggtgttccctgaggtaccagaagagcctgtggcatttcctaagccagggtggcactggtgggaagggcagtgagtcgttgcagaggtgggtgggtgatgatgcagctattccttgtgcaacagtgaccttcagacagaggaactggtgggcctagaagcactgcctggcatgctgactatcagggcttcctggaagccgtggcctggaccttcttgccttctgagtcatagagccaggcaggcatcctggggctgccaggcacacacacacctaacctgtaggctgtcggggtcaaggcaaagaccaaacaccaggcatgcctgggactgttgtcaccttttattctagtggggcctacctgcttccccaaatcaaagatgcatctataccaggaaattaaaataaagtaaaaagaaatagtttctttatagaggaaacaggagagaattagaccagaaaccagagtaagatttataacagctgagcacttaatttggctctctgagcagacagtaaaacataacaggatgcatgattatcacttgacattttttcctggcaccacattccaagcagaattgattccttgtactcttacgtggaggatatagagtaataaaacacgtaatttatttgaaagcatttatagagaagacaaacactggtcatgagcttcaggtacccttcattccctcatct

SEQ ID NO: 19416 - DNA, 1815 bp, Homo sapiens
ctttggaagtgagagcacttcctcatagaccttggatgtgggaggattgcattcagtctagttcctggttgccggctgaaataacctgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccca

SEQ ID NO: 19417 - DNA, 2280 bp, Homo sapiens
caagtcacatagggataaatcacaatagttggtcaactgttgaatcttgatccttcaactaaacaatattcatgaactctgcagaaaaacaccagcattttgctcaacattcaggaccctctagaagttgcctcattctactctcctttcttacctttcttttacacagctctccaaaatgtccacaaaagtgacttaagtcaggttcccccaaaccagacaccaagacaagaatccatgtgtgtgtgactgaaggaagtgctgggagagccccagctgcagcctggatgtgaactgcaactccaaagtgtgtccagactcaaggcaagggcactaggctttccagacctcctactaagtcattgatccagcactgccctgccaggacataaatccctggcacctcttgctctctgcaaaggagggcaaagcagcttcaggagcccttgggagtcctccaaagagagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccca

SEQ ID NO: 19418 - DNA, 2162 bp, Homo sapiens
gtgggaggattgcattcagtctagttcctggttgccggctgaaataacctgctctccaaaatgtccacaaaagtgacttaagtcaggttcccccaaaccagacaccaagacaagaatccatgtgtgtgtgactgaaggaagtgctgggagagccccagctgcagcctggatgtgaactgcaactccaaagtgtgtccagactcaaggcaagggcactaggctttccagacctcctactaagtcattgatccagcactgccctgccaggacataaatccctggcacctcttgctctctgcaaaggagggcaaagcagcttcaggagcccttgggagtcctccaaagagagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccca

SEQ ID NO: 19419 - DNA, 1446 bp, Homo sapiens
gctgtttatcatttgactcatcatttaatcttgatttccagcttctcacacttgaaagaagacataatacatttctcacaggattctgggactattaactgaacttatgtgtgtaaaaggaattcatacaatgaaagcactagaaataattattatacttataaccattgtatttttacatgtttaaaatatagccataattagcctactcaaatccaagtgtaaaagtaaaatgatttgctttcgttttgttttccttgcttaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattc

SEQ ID NO: 19420 - DNA, 1967 bp, Homo sapiens
aacagattgacccagtcgacaggatctgaacttccagtgaccatcccaggaacagaaagcaactgtgttaccagttctgcttttcctggacctgttccaagctctcacgttccacatcacacatgggacatctagtgtcaggctcccagagagcaggaaccaggtgaaatataagagcacagtcctcccagccggtggcatggggataatcggacaatacaactctccacccttttttatgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 19421 - DNA, 2332 bp, Homo sapiens
acttcctcatagaccttggatgtgggaggattgcattcagtctagttcctggttgccggctgaaataacctgaccgagagcatcaccccctgaacatggacttgcagaattccacagaagagaggagactggcctagacagacagccccaggagctgagggcccaacaggctttctaccctggatgctgctcccatgccctgacatgaggcccactacaatgctctccaaaatgtccacaaaagtgacttaagtcaggttcccccaaaccagacaccaagacaagaatccatgtgtgtgtgactgaaggaagtgctgggagagccccagctgcagcctggatgtgaactgcaactccaaagtgtgtccagactcaaggcaagggcactaggctttccagacctcctactaagtcattgatccagcactgccctgccaggacataaatccctggcacctcttgctctctgcaaaggagggcaaagcagcttcaggagcccttgggagtcctccaaagagagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 19422 - DNA, 1948 bp, Homo sapiens
acttcctcatagaccttggatgtgggaggattgcattcagtctagttcctggttgccggctgaaataacctgaccgagagcatcaccccctgaacatggacttgcagaattccacagaagagaggagactggcctagacagacagccccaggagctgagggcccaacaggctttctaccctggatgctgctcccatgccctgacatgaggcccactacaatgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 19423 - DNA, 2066 bp, Homo sapiens
acttcctcatagaccttggatgtgggaggattgcattcagtctagttcctggttgccggctgaaataacctgaccgagagcatcaccccctgaacatggacttgcagaattccacagaagagaggagactggcctagacagacagccccaggagctgagggcccaacaggctttctaccctggatgctgctcccatgccctgacatgaggcccactacaatgacgtgtacagaagggccatgctgttattactcttacacaaggaggcagccctcgagccacagggtccagctgttggctataatagcctaccggtctctgatgatcaccatgtttctggaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 19424 - DNA, 1322 bp, Homo sapiens
tgagatcacttcccttgcagactttggaagggagagcactttattacagaccttggaagcaagaggattgcattcagcctagttcctggttgctggccaaagggatcatggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgagaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatcaaatactttcatccataaaaatgtcagcatttattaaaaaacaataactttttaaagaaacataaggacacattttcaaattaataaaaataaaggcattttaaggatggcctgtgattatcttgggaagcagagtgattcatgctagaaaacatttaatattgatttattgttgaattcatagtaaatttttactggtaaatgaataaagaatattgtggaaaaa

SEQ ID NO: 19425 - DNA, 947 bp, Homo sapiens
agacggtatctcctggatgccagtgagcggctgagagctgaagctccctggacactcaaggctcttgtggtgacagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctttgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattca

SEQ ID NO: 19426 - DNA, 5571 bp, Homo sapiens
gagcgcatccctaacacggccttccgcggcctgcggcagcacccgcgcgcgcagctgctctacgccctgctggcggcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctttgcccgcctgcccgccgcccggcgcggcctgctttcagacgctcaattggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggccccagctggccacggcgctgctttgctccgcgcatgccgagggtgtggcccggctgagcatgccgcatgcacacagccccgccctgccgccctgcccagactggacccggagacccgggctggtgagcgcccctgtccccagcccccagctggctgtgggagggcctgcccctgcccccacctcctggagggcctggtctgccccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgttttgctgttggaaacctggagggaaaccctgattggatgtcatttcctgccatggagcacgcctcccagccctggcctgcagtgtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacatgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctggggcacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccatggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgtgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggtacccggcggtggtgggctggcagtgcccggggaagcaggtcctgctcacggcttccctgctgggccccaggccccgggctgagcctccctggcccctcttgcccctcagtggagcagggcctgggtggagggcctgggcagctccagggcaggtccggggaggccaggcttggggagcacagggggtggggttcacctgctgctgtttgttcccgaaactgtactgtgagcccacggcgggggcagattgttctgaggccccagatgtgccaaaacagcccccagggtgggggcgagcgagttctgaggagaggggctgcgggggccgggggtgggtgtgtgcccctcccctgaatggcccccaatgctgctgtttttcaataaaaccagagttgaaggca

SEQ ID NO: 19427 - DNA, 5870 bp, Homo sapiens
atgcattgtgggcctcccgacatggtctgcgagacgaagatcgtggccgccgaggaccatgaggcgctgccgggggccaagaaggacgcgctgctcgccgccgccggcgccatgtggcccccgctgcccgccgcgcccgggccggccgccgcgccccccgcgcccccacctgccccggtggctcagcctcacggcggggcggggggcgcggggccgccgggggggcgcggcgtgtgcatccgcgagttccgtgcggccgagcaggaggcggcgcgccgcatcttctacgacggcatcatggagcgcatccctaacacggccttccgcggcctgcggcagcacccgcgcgcgcagctgctctacgccctgctggcggcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctttgcccgcctgcccgccgcccggcgcggcctgctttcagacgctcaattggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggccccagctggccacggcgctgctttgctccgcgcatgccgagggtgtggcccggctgagcatgccgcatgcacacagccccgccctgccgccctgcccagactggacccggagacccgggctggtgagcgcccctgtccccagcccccagctggctgtgggagggcctgcccctgcccccacctcctggagggcctggtctgccccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgttttgctgttggaaacctggagggaaaccctgattggatgtcatttcctgccatggagcacgcctcccagccctggcctgcagtgtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacatgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctggggcacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccatggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgtgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggtacccggcggtggtgggctggcagtgcccggggaagcaggtcctgctcacggcttccctgctgggccccaggccccgggctgagcctccctggcccctcttgcccctcagtggagcagggcctgggtggagggcctgggcagctccagggcaggtccggggaggccaggcttggggagcacagggggtggggttcacctgctgctgtttgttcccgaaactgtactgtgagcccacggcgggggcagattgttctgaggccccagatgtgccaaaacagcccccagggtgggggcgagcgagttctgaggagaggggctgcgggggccgggggtgggtgtgtgcccctcccctgaatggcccccaatgctgctgtttttcaataaaaccagagttgaaggc

SEQ ID NO: 19428 - DNA, 4988 bp, Homo sapiens
ctcgcgggaggcggttttctcccgcctgctgtgctctgtgacctctctgctgcctcctccacggtctctgggcggagcaatccacactgctgagcctggggtggtttggaattcttcggcgaagtggagcgggctgagattcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaaaaaaaaagaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgtggtgccacgttagccactaaatctgaacttttaccctgctttcatcatggatttttttgtgtaacctgaaacaagtcaccagtgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctcttcgtgaatacccatagcaatatgtaagattttattgaagtttcctgtgataactgaggaatactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaaccgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaagggaaaaaa

SEQ ID NO: 19429 - DNA, 565 bp, Homo sapiens
acactgctgagcctggggtggtttggaattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcgttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggc

SEQ ID NO: 19430 - DNA, 2672 bp, Homo sapiens
ggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaataatttcctgaggtgaaaaaccgatattgaagattcatttttcttttttccattcttcaggaccttcggcaagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctcttcgtgaatacccatagcaatatgtaagattttattgaagtttcctgtgataactgaggaatactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaaccgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagat

SEQ ID NO: 19431 - DNA, 575 bp, Homo sapiens
gcgcccgcggcccgggatcccgagtgtccggagctccgtggtttctgttggacctcgcgggaggcggttttctcccgcctgctgtgctctgtgacctctctgctgcctcctccacggtctctgggcggagcaatccacactgctgagcctggggtggtttggaattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccagttacattggttatgaattagccgcagacatggacatcgtttagaaagaagttatgtaatctttaaaaagaagattacctatatcccacaatagtgtgatttttgttgcaagaaaatactgggtctgttaaagaagaaatttaggttcttcaccaaaggacatggatgaaaatgaaag

SEQ ID NO: 19432 - DNA, 1822 bp, Homo sapiens
gaaggaggccaccgctggccctgctgtcagattcgaaggtcataataagggagtgacccggcgacgactcgccccaacgatggcgaggcggcgagagctgaagcgctgcctgcagctgctggcgtcctcggcggagccagcgcggcgggctcgggttaggaagaacccgagcgcctgccgcggtcgcccctcccgctacgcggcggcgctttgcgcggggactctgtggccggaagccgcggaactgaggcggcgcgcgctcccggccaccccaagcgcgagttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattca

SEQ ID NO: 19433 - DNA, 1822 bp, Homo sapiens; identical to SEQ ID NO: 19432

SEQ ID NO: 19434 - DNA, 2380 bp, Homo sapiens
aattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaaaaaaaaagaa

SEQ ID NO: 19435 - DNA, 3220 bp, Homo sapiens
ctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggttcctgctggtactttgtaccaaaccatccccaaccccacctcccactctggggtgcagagaccctaggttctgggtgtggcagccacaagggcttcatctgcctccagtgtgagaagggagggaacagtgagaggcttagcctctgcctgtcctggcaaccaggactctgtaccagcctagcttccctgctgcagccccttccattagcaactactctgtaccacccttcccaagagtatgtctggaggactagtgtgaggccctgtctttccacggcacccatgggcaaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagagga

SEQ ID NO: 19436 - DNA, 4293 bp, Homo sapiens
gtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagccttttcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcggctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagaaccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgagagagagagagagagagagagagagagagagagagagagagagagagagagaggtttgtcccgtatatcttgctccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgttttcctaagtgtccttatcccactggattgtgtctcttactcccaagacttattccaaatgattttttgagtcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacagtctgacatcgattgtctgaaagtactaattgcatttaaaattctttaagttaactacaagctcccagactgcaaagcaaatttccaaaccccaggtcatacttttgtatgtatgtaaaagctttagcattttagggaaaaaaatcaatctgtattttaaaaataaactttgaggtttgaaaataataacaatattcataatggtagtattaacatctattatgtataacttaatctcaacataatttattgaattagaatgaacctggaacactttttgatgaattggtatcctagaggctgtttccttgggcattaactgctggaggattaggtaatcagggattccaagtgttgtgatcttttttctaatgacgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcgcagttcatgtgtaaaaacaaaaccaaattcctggattatcaatatcagttctttacctgtgcataaaagaatatcatgaagtaattgaacttatctgttgatataaaaacacagatccaattcatgtctgtggatgctgcagggactggctcactggagccaaaccatgtggcagaaactcctgaaattggtggaaaaagtggaatatggcagattgggtaggtaggagaacaattttggagattttgtttctcatgttaaaatgtctgcattttatttgctgtaccctgcctactctggttttaaggattttttgacttctttgaaaagcactgaataatctcttttccaggtctagattttttgatgagtactgtgtaaaattgtcaatattcaatggattatttaataataaattaagaattacactcataaaa

SEQ ID NO: 19437 - DNA, 2050 bp, Homo sapiens
atggactctgagaaatcttctgagtggcggagtgatgtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagccttttcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcggctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagaaccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgt

SEQ ID NO: 19438 - DNA, 3235 bp, Homo sapiens
agtgggcgggcgcggcgcattgctgctcggcggcgccggcgccggggtccgggcggccatggggcaacaggcggccagggcgccaagggccaggtagcgacggctggcggcggcgcggcggcggggcctgcgggctcggtccggcatgtagacgcccccgcaggcgcccgcggcagcgaacggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 19439 - DNA, 3098 bp, Homo sapiens
gtagacgtggcgggcggacccgggggcgccctccggacgcggcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 19440 - DNA, 1789 bp, Homo sapiens
agttgcttttacaacaactttaccaagtctcatcacaattgtgttttgctttgagttttgagtatgaagagcttaggcttctagtgtgggcgcacagtcaggaccataccgatggggcggccgcgtgttcgccaagcgtggcctggatgctgtggacacactggccggctcccagcaggcaggggctacctcgcgagccacatgtgtgacccggcaggtgctgagctcataggggatggcatgagtgaccccacgcctcccagtaatgcctgcacagggcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctctt

SEQ ID NO: 19441 - DNA, 3663 bp, Homo sapiens
agtgggcgggcgcggcgcattgctgctcggcggcgccggcgccggggtccgggcggccatggggcaacaggcggccagggcgccaagggccaggtagcgacggctggcggcggcgcggcggcggggcctgcgggctcggtccggcatgtagacgcccccgcaggcgcccgcggcagcgaacggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggcacattcaggaccccgcgagccagcggctgacgtggaacaagtccccaaagagcgtccttgtcatcaagaagatgagagatgccagcctactgcagccgttcaaggagctctgcacgcacctcatggaggcacgcggggcaggggggaagggggcctggggtgcacatggagttgggggggcctccatccacatcaccgccccgagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtag

SEQ ID NO: 19442 - DNA, 3653 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggcacattcaggaccccgcgagccagcggctgacgtggaacaagtccccaaagagcgtccttgtcatcaagaagatgagagatgccagcctactgcagccgttcaaggagctctgcacgcacctcatggaggcacgcggggcaggggggaagggggcctggggtgcacatggagttgggggggcctccatccacatcaccgccccgagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 19443 - DNA, 663 bp, Homo sapiens
agagcttaggcttctagtgtgggcgcacagtcaggaccataccgatggggcggccgcgtgttcgccaagcgtggcctggatgctgtggacacactggccggctcccagcaggcaggggctacctcgcgagccacatgtgtgacccggcaggtgctgagctcataggggatggcatgagtgaccccacgcctcccagtaatgcctgcacagggcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtc

SEQ ID NO: 19444 - DNA, 2773 bp, Homo sapiens
agacggggcggggcgatccgtaggcagggcctgacgccgcagtcctccttggccggagcctcaacggatgggcggggagggggcggggccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccaagtgctgcgcaaagccaacaccagggtggatctcgtgactatggtcaccagcaagaacggtgggatttacttgctggccaaccagaagggttgtgacggggaccgcctgtactacgacggctgtgccatgattgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagaggctggaatccaatgcacatgattttgacctcccgccagcgtgcgcttccccgcgaagtctggcattctccgaaggaagccgcctgggtaggagggttccaaccgccgccccgtgtggcatctttgctgcaggaacaagaacagtagctcccgggaagggaggggtgtcatgagcagaaaatgaaggagagaagaccttctctcccacccacacacaccttcctgtcctgggttccagaaggttctggggagatggtccctgcagagctttcttcc

SEQ ID NO: 19445 - DNA, 2304 bp, Homo sapiens
atcattaaccgcgacagagctggaagggctttgaagagaaggattaagttcctgctgatgggaagtgtggtcctctccccgttcacgtcagagccacaggcacattggtggtcgtgttgattggcaggtgtgttggcaatcaatcacctgccccaggacccccgcaggttcccggccccacatcaagccaccaaatcggagtcctcgggggtctgtatatttagtgagcaccaggcagttgtttcgtgcattagaatccgggagccgttgccttacacgtctctagagttcctgatgttgcctgagagctccgtcgtaggctgtggccacaggcctgctgtattcagagtggccgcgctgtcctcaggctcgggccactgccctccaccaggtcctccgtggtgcacctgaaatggtcaacagaagtcttgtgacacgtggaatcatttcagagtcaccccttctgcctcctgctcaagcaacagacctgccgatcacccccgtcgggcccgcgtttctcagggtcttcctaatcccctgggctttccggcttgtcgtgtgcctggagtcaggccgccgtgcggcaggctgttaacctagcctcggggagagtgggatggagccaccttctcatggaacgatcctcgccttccctcatctccattgttttatggcttcacacggaccgtggctttctgcatggaagcttggtggccagggtgctgtcactttgggaagcagccagagaaccacaggatgcgtgaatcggtctccttgtcttcatgggcatctccggccaggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggctt

SEQ ID NO: 19446 - DNA, 1929 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggta

SEQ ID NO: 19447 - DNA, 994 bp, Homo sapiens
gaagctcggctgattctcggctcacgcgggaggggagtaaagggtggcggtccgggcctggagttcagtgggtgcagcctgcttgcgagctgaggccagacaggggggcgcctacggacggataaggaggagcattccaggccgagacgccctcatcagcagagtcacaggagttttggaagtgagagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctct

SEQ ID NO: 19448 - DNA, 1630 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggataaggaggagcattccaggccgagacgccctcatcagcagagtcacaggagttttggaagtgagagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtc

SEQ ID NO: 19449 - DNA, 2765 bp, Homo sapiens
cacacacccctacaatcccctcccccagccccgagagacttttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttactatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 19450 - DNA, 2474 bp, Homo sapiens
ccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttactatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagaccc

SEQ ID NO: 19451 - DNA, 2405 bp, Homo sapiens
caaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttactatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 19452 - DNA, 924 bp, Homo sapiens
acacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataac

SEQ ID NO: 19453 - DNA, 1515 bp, Homo sapiens
agcgagtgcgcggtccagtgcggccggaacctggcgcaactcctagagcggtccttggggagacgcgggtcccagtcctgcggctcctactggggagtgcgctggtcggaagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaagctttaggttcattcttgtaagtgttgctggtgtcagaataggaacctccctgcgctttgaagggatgaatgtgacctctcccacattctccggtgctgtgatgtaccttaaacacagcaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggg

SEQ ID NO: 19454 - DNA, 1098 bp, Homo sapiens
cagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggg

SEQ ID NO: 19455 - DNA, 1021 bp, Homo sapiens
cagtgcggccggaacctggcgcaactcctagagcggtccttggggagacgcgggtcccagtcctgcggctcctactggggagtgcgctggtcggaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagcta

SEQ ID NO: 19456 - DNA, 851 bp, Homo sapiens
acctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagcta

SEQ ID NO: 19457 - DNA, 977 bp, Homo sapiens
ccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggg

SEQ ID NO: 19458 - DNA, 689 bp, Homo sapiens
gtaggggaggcggggctggagggagatggcgccgcgctcccggatgaacagagaaagcgacaggataagggcctcgctctgttacccaggctggagtgctgtggtgtgtttgtgactcaccgtagccttgaactcctgggctcaagcaatcctcccacctaagcctctggagtagctgggactacagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccag

SEQ ID NO: 19459 - DNA, 833 bp, Homo sapiens
gcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagctttaggttcattcttgtaagtgttgctggtgtcagaataggaacctccctgcgctttgaagggatgaatgtgacctctcccacattctccggtgctgtgatgtaccttaaacacagcaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccag

SEQ ID NO: 19460 - DNA, 626 bp, Homo sapiens
caggggaatggctgtgacaataaataagattgggaaaacaagaagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttataagggcctcgctctgttacccaggctggagtgctgtggtgtgtttgtgactcaccgtagccttgaactcctgggctcaagcaatcctcccacctaagcctctggagtagctgggactacagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctg

SEQ ID NO: 19461 - DNA, 975 bp, Homo sapiens
actcctgggctcaagcaatcctcccacctaagcctctggagtagctgggactacagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagatgctcagcaccgaactcagtctgacttccagatgctaacaacacaccccaggcaggcgaaggggcatgcttttccatactcttccttttgactggcttgatcacagactgctgctccaaagctggtgttacgcacagctcctcgtcccctccctgcctgcccagggccagcatcaggggctgtcatcactgggggatgcagagctacctgtaacagcaacaaggaccattgtcaactccgttcccgtctgacacccacactgcacctttcagagctgaccataagggttaccctcacctgcccagctgccagggaagaggagggctgtgggcttcattccgaatcaccagataaactaaactaggaaacctgaggcgagccgcagcctcagtttctctttggtgttgccgcccacagttcccgctgtactggttcagcgtgccagccatcctgaagggctggatggatagggtgctgtgccagggctttgcctttgacatcccaggattctacgattccggtttgctcca

SEQ ID NO: 19462 - DNA, 627 bp, Homo sapiens
gttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcctccagggtgcagaatagttaaagacacctccctctctctcttcagcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaa

SEQ ID NO: 19463 - DNA, 766 bp, Homo sapiens
tttctccgggctctgggtcgcaggccgggcgctttctgcgtccagcagcccctttccgcccaggctttttgaaaaggaaggtgcacacctgatccaccgcctttcctggagaaagctgctctgccattttagagtcctgagctccgaaacagccgtggctgcctgggttgcacttggcccctgcacgtcactccacgttgcgcgctccgccgggagtcgaagcaaaagacactgacggaagaggactgcgagagcccgagcgcccgtctctcttgtgccctagcagattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaa

SEQ ID NO: 19464 - DNA, 4915 bp, Homo sapiens
gcaccccggccgtgacgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaatttccccatcgtacgtctatgtgcgtgcgggcacgtcgaaactgcacacgtgcacacacgctgctctgggccctgtttggtgtggtgtggtttaattgaggcttacattatgctgaagagtttttctaaaggcctactgtatttattttagtaatgtgctacattagagtagaaaaaataagaacgtgaagaagaaatagcaaaaggagaaaattaccacagatttacagaacaatatgttttaagagagacgttgagaaagattcacgtggccgtcctcagcgtctcaaactcctttgaagggagatttgagcttaggctgttgatgacataagatgcaaaagcaaaataatatactctctttattacccagaaaatcaagttgccagtcaaaactgagaaatgagaaagaaaatcagatttctttattcatctctgttgaagcctagaaaaccaaaacaagctggttgtggttcagcatcatggtttaggaatcaagctgtcagttgtgagtcctactgaactgtgggttttccactgtaaagctccactgtgtccattaggaatcaggctgccagttgtgagtcctactgaactgtgggttttccactgtaaagctccactgtgtccaatatggtagctcctagccacatgtgggtattgaaatttaaatgagctaaaatgtaatagagtttaaaattgggttccttggttgcactggccatagttcaggcactccacagccgcctgtgggcagtagttccagtgctggtgcagaggacgatgctctgctccccgcggaagctctaccaggcctcgctgctgcggagcatgcgaagaagatgcacactccttccctccttgcgtccgcctgcctttttccctctccccttccttccctccttctttcctcctccttccctcccttcctttcttccttccatctgtccttgttttcctcccttcccttcctccctgcctctttccttccctccttctcttccttccttccgtctgtccttgttttcctccctgcctctttccttccctccttctcttccttccttccttccgtctgtccttgttttcctcccttcccttcctccctgcctccttccttgttttaagaatttgaaaataaagtttcccaggagttttgaattggagtcgagatttaagtggctgaagttttgcatttcactaggaaaccaacagctttaatcatgaaatgaaagcacagctgggcattgggccagtcacagagtgtcttttgctctgagcacttcacaaacccattgtggaggggaggaaagaaaaagaaagccatctttaattatcttagctgttcctaatgtctttggctgcaaagagctagctgtttccttcaaccttggtggttgcacgggtagtgtcctcagcagtgagagggcaggtctgccctgtggtcaggattgcccttgtgaggggcagagctctccaaccatgcagggctccgtgtcggcatggtgtggactcgggtgctctgatcatcccctgtgtttgcgtctgaccctgtgtggttgcattcccttgatggagtgggaagtatgtaatttgtagtgctgaggacattcgtctgtttgattttctggtgttttcaatgacatgcatgttcagcagagaaagatgaataaacactgtccaattcttctctccacatagaagcctcaagaagaggtgaggagatgccccgatttccttatttcagagcagtacatgcgttcgtctcacgaaagctcttacaactaaaacaacagcaccaacaaaccaggatcaaaataatcgtgcattttccaggattccatgttggacttctcagtgctttggagatcaggaaataatcatgctgttgcagcagtatggttttgtgtctggattttattcatacaggcatgtgtttacaggcatgagaattctgtattgaaaagaaagtccttgtttttttctaacgtatctttctgttccatcaactgttaaaaccaaattgttaagaacattgagcttcttaggagagattacatgcagctacttaggaccacctcagcaaaatggagttgcctgggtagatagcagcagcagctcaccagccccacgctgccaggctgctggctgctgtccaccaggcagctgtggaacctccatgttctgcctaggtgttgtggcaagaacagcagggaaacaggcggccgcctccaggccacaggtggacccagggaccttcagttacgccgcttcaattgaattcgtggtggtttctctgctacagcagaagtggaagaagctcttgtcttgtttggcatttgtcccattttttggctaataattggctttgaatttctctgtgccctgcttaccaattatagctttctggattggctgttcttagcagtgcaaatgtcaatgcaaagaagcaagcaggcggctactttctgggaagaagcatagtccgtgctcacactggatataaatctgcaagatttgggggtttggcaaaataggggtggagggaaagctgccatggctgtcagaaattggggctttttgaagaaaagcttgtgtaggcatcagccactggctggccagaattccatgaatggaagcaggtgcccgagtgatctggggctttacatgtggatataaatagaagccgggagcctgaggctttgctttaggaaaatcatgagccagaaaacagaggaggtgattgtcagtagtcacctcacgccgctagtgttttctaatactctctcgaattgtcaaagcaaaggaccttataacagcaacacgtgtgtgactcgaagcagcgagcttcccttgggaaaaggagcctcttctcagcagagggtcccagcctttctgtccttccccatcggaatgccaggctctgtgagtttggatgttggacattgccacctgaattccaggaggccggggagctccagtgatggacttgtccccaaaagagtggtgctgttctcagagccataaatgttccactgaaagtgtctgtcccctggctcacgctggctgcgcttgcttgaaggaggctgatttaagggttctaataggaagacaaatgaaactgtcaaattttatctttaagcatgtgagtaagtttgctcattcgcttttactattgatgtatagttttaaaattcttaatttaaaaattattttaatagtaaatttttcacaagtgaacactttttatctttaaattaaaattctgaagctccctagttagttagatccaattgctggttacattttgggaagctctcattttagtgctatgtagtttcattgaataaacatgtttttaatgaga

SEQ ID NO: 19465 - DNA, 1489 bp, Homo sapiens
accgcgtccccttgggtccttgatcctgagctgaccgggtagccatggccttgcggctcctgaagctggcagcgacgtccgcgtccgcccgggtcgtggcgcgggcgcccagcgcgtggagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatggg

SEQ ID NO: 19466 - DNA, 799 bp, Homo sapiens
acctaggactccctgagctgggactagcgaaatctgtctgcactgatcgcagtcgtcctcagtttcaccctctaggaatcggcctggggatgcacgtgctactctcttcctccaggccggtccccggcgcgtgcgcgcgatccatgtccatgtccgcgcctatcaataaagttgctcacttgttgccggcccgctagcccgaaaggttgcgcgcgcagcccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 19467 - DNA, 747 bp, Homo sapiens
ggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagacaggatctcactgtgttgtgcaggctggtctcaaactcctggcctcgagcagtcctcacacctcagcctcccagagtgctgggattataggcatgagccactgtgtacagagattctgggtcccttcttccagcgcctgcctcgaagtcctctctggagagagcacagatgtccacgcgtgttccagcacaaggggggcatgcaacagctcagggtcacgtccacttccggagctgggtgcccgggcctcgggctccctgagaaagggcggacacacccaccccgcacccagaggggcaggggccctgacacctgtccaagccctaatagagtcattgttaaacactctgggttcgaaccccagaacttga

SEQ ID NO: 19468 - DNA, 762 bp, Homo sapiens
atgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctggcctgcc

SEQ ID NO: 19469 - DNA, 959 bp, Homo sapiens
gtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgg

SEQ ID NO: 19470 - DNA, 804 bp, Homo sapiens
gcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaagctaccagctgctgaagcaaacatgaagggtggcgggggggcagggattctagggccccagagtaagtagaccacactgagt

SEQ ID NO: 19471 - DNA, 743 bp, Homo sapiens
gtcaccgagtcgttggcgctgtcatggcgggtgtgctgaagaagaccactggccttgtgggattggctgtgtgcaatactcctcacgaggtatgtacctttgttctttcttcgttcttgaattcccaaggaagactaaattcctgtcactttgcttattgcagggttaacgggatacagatgtttcaagcccttaattacaagccgcgtgagctcttgagacacgggcgctgtccacctacttcgttgatccgatgtcacatttttatttatttttgccatgacctctttattaagccagttttcttgttgactttttccttgacattttcatggcttcacttgtgcttgcttctgtcagcgccatctcaaatttatatctccgttttccatcttttctccttgccttaccgtttctgcttaggtgcgttggattacatatatttaggcttactaaaggtactgcccccttttccttctgttaggtcttttccatctgtattcacgaatgttttcatcaaaaaaacccacaaattttttattcttcttgtcccttctataatcacaccatttctttgcttcactttacagataactcaaaagagttatctctattttctccaatttctttcttattcacccttgaatgcactcagtcacccttggcgtttttcaagttcaccaattatctccatgctgccaaatccaatggtcagctcatatttctcaccttcattgacctaa

SEQ ID NO: 19472 - DNA, 1901 bp, Homo sapiens
gtgcgaagaactaacttgctgttgagagatcaattcagaggatgctcaagctccgttatcactttcattttactaaactgagaaaggaaggttgaggaatgcatcaacggttaagcacagtgcaggttcctacagcgactggagttttttggtagttgggagtgtttccctcaatctttgggcaagccgtcagcagtggcaggaacaggaacagacagctgggaaaccctttctttccccaatcgtcttctagcttagctttaggcttgtatgcccatcgcgcatgcgtcaatttttctcttttaagatgggcggggcagagtctttgctcctttggcgatcctgaaggggtggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 19473 - DNA, 5608 bp, Homo sapiens
aagaaggtgagacgaatggaggtcactgttggaatttagactgtgggggtagactcagtccgatagccctacttcccgcgggtgttgacccctactgtcgcgggctcggcggtgcttttcggggactcgttctgcatgccttaccgggtagggcagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttcctagctccctgtcattcctaaatacttggttaaatttaacgtggtatctctttccttcatagatagtactatactcttgtggggttttgtgtatacgtgtgtgtgtgtgtgtgtgtgtgtgtgtgtgtgtgtgtgtgtgtgcacgcgcatgcgcacatttgctcagaatgagaaaaaaatggtatttttccttctttccagtatatttctcccctcatagagctgtaacatgaatactaaataaatattaaataaggtggattcttagaggttagagtgcaagaaggctccttctggtggggaagtgttagagggggagttagaagcccagggtttctcattctcatggttctagtgttgttaactcaatgactacattgaggcaagtttggcctgtttctcagaatggcctatttctaatgctgcaaaagaaatagaatatgatttataacaacattttcagttctaaacatttcttgaatatataatatatttattaaaacatgatgctgaagtgtgtttgcatgggtactttcaaggtaattttctagccaaccattatttttcaggtcctttggacaacacagaaacaaagatggcttgctgtgtttttgtcatattttcagtcccgtatctgccatgattcttgggcatcttttatgtttcaccaacagtgttactgaacttttttgctaaaaggggaccttactggtgtttgcattagaaatgctagttgcagaataatagtcattgtaaaaataatattataacaataatagctaatgtttgttgagactttaatatgaatgtcaggcactatcataagtacctgactaatttcactcattaaacctgcactacaaccctaagagtgatactacaaattatcttcattttccagataagaaaccagaaccctacgtgagtagttttcccctgcaattatgcaacttggggccttggggacactgaaaccaagagatgatttaataacaaatccaaggtcacatagctagtaagatgtgaagctgaagtttgaacccaggcagtctggttctagaactgatgctcctgttatattattatttatgaatatgcttgggatgttgtgacttcttcctgtgctgtatgggctgtaccaaatgaaactagatcctgctctctttaccttttctgtcaaaattatctgtaaagaacaaatatgagcagaagtagtaaacgatttcattttctgcaaagagctgcatataggttataggcagattatgttaatgggataggtatctaaaaggtattgcaatttggtcattggttctttctcctgtctcaattgctcacagaactttacacctgatcgtttttactccttcagtcttttcccagttgcttcctataaacatccaggttaagtctcctgatcactttgcaaatgattcttttattcagagatcttcagtgttttgagtggctactaaactaattttaataattttcagaatggcctatttcagttctcccatgggtttcattctagttaatcatcatactgcagatacttcaaaagaaagagaagctaatcaatttgagctttgctaagaaagaagaaatggcaacaaagttgatgccccctttctcccacactgggacttagtgcagacgattccaatttcttggcattctttcctttgggatgaaaatggcttatatttaggataactataggataatttatcattccacttggaatgattttgagtgaaaataattacataaggataacagatgtacaccatgactgtcctgggcaaacaagatataggggggcaccctactggagtaaggctcaggtctcaaggttgccatctttcccacaccagtaggatcaactagtctgtcattggaatagaatgaattgatgccagcagtagtagtcatcatgtgcaatcaggcctcaagttttattgtatcctttcactctccctcattctcccctccccctccttttccctcagaattgggggatggaagaaaagagagcttatattttattgtcaattttctaatcacattcagaggagcgaagctaattaagccaataacaatgtttatgaatgtatcttttttaaaagggagatgacaatatataggaaaattcccacatgtaggctaatagcagctttttctttttcctcccatcctctatgattatgtaaacatacagaagtctaacaccctacacaagtgtattgtggggtatgggattaagtaccaaattgctgaacatatcactagtattttggatttgctgagtgcagtcttcccattaaaactaagtgttcagtagggaggcgtggtggctcacacctataatcccactactttgggaggccgaggtgggtggatcacttgaggtcaaaagttcgaggccagcctggccaatatggtgaaaccccgtctctactaaaaacaaaaacaaaaactaagtgttcagtgagattgtagcctatgctacaacaatagtaatgccaattgttttagagaaaagtaaatgagaggctaccagttgtgtttagaggaggtcgacgttttattttagacaaaattcacaggaaatcacagtgggaatgtgataaggggtttgaatgattgatggggacaggaagaattcatttgagagactagagatgagtcagtattctagatcgtgaagtaaaatagtgagtcatgtagtgacttagcatgggttatccttaaatcccagtgtcttaagtgtattttttattcatactgcatgtctaaggagggttggcaaggagtgctcatagacccacaaggaatccaggctgagtgtggcaccatcaacatatatttccatgaccatagtggtggtggggaattggaacatggtaaattacacataggaataaaaaaaaagaaacaaccaaggttaaatttttttttgactgtgccacaaaatttatgaattgaacttgccatgcatcactaataattttcaaattggtctttaggtttacattagcagctaattttttgtggtacacttaaatgtaatttatgattggcatctgtatataattaaatgaaaagcattgcaaagatttctattttggtatttctcatgatcttcaatttttttttaggtgaatctattaggttttctaaagataactatttttttttttttacaaaatattggcattttaatctctctataactggagggtgaattatttttcaccagagtaaaacaggtccaaagtcccttatctaaattcctaatttcaaaaatctctgaaaacaaagttttttcataactcatttggcaacaaaccccacctgaattacatgaggctatttgtggtatttatcgcacttcaatgtgaatatgaatatattttgccacagatgtatcaatatatttgattctaaactgcttcctcagaccctcttaatgtgttacataatgtaaagtatatgcccatatttcctttcaaaaatctgaaaaattgtgaatatcaaacacatctgtcttaaaaggtttcagaaaagggacaatagacctatatttccattctcttaacaagttcacaaagtggtattatgatccaaatttaatctaaataatttccaaaacaaaaattttcaggtccttagttttctaaattattttaatattaaaaatattcattattcattttaacctgtagtaacaacaggagatactttgaaatgcttgattttatcaagccactaggtggcatctttgtaaaaataaaagcacatcaaaagaaatgtttattacataaataaatgctgagatgaataaaggtagatgtttcatgagaaatacgaagtcgtttggtggaataaatcctgagaaaatgcatagatttatcatgaaaaggaaaatggaaaatggtattgtaaaattactctttcacttttggaattgagaagctttttcctattggttgttttcattaagtttgaatataaatttattatgtaaccaaa

SEQ ID NO: 19474 - DNA, 1256 bp, Homo sapiens
ggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgat

SEQ ID NO: 19475 - DNA, 535 bp, Homo sapiens
acgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccatgtttcc

SEQ ID NO: 19476 - DNA, 844 bp, Homo sapiens
ggttgggcagggcaatacgcctgcgtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggagtttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaa

SEQ ID NO: 19477 - DNA, 1000 bp, Homo sapiens
ggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggagtttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggggtgactttcccaaggactggagagagatggagaaatagacactgcagcatcatggtgaagaaactcaagccctggtggagctgggagaacaacgacacttctatttccagtctctccaagagcatgcgtgaagccaggcccatctgtctgtgggagaggtctgtgccatggtattgggcaaactcacaggtcaccgtagcccaggattgcaatgtcccaaaagcttgtcttgatctagactagaaaccacagcccagcccatgcgagcaggatgtacccttagggtcatctggcttatcctctaatctagggggctcagacacagcaagtgaccccttgccccagtccccctcccccaggtcacacagccagtcaggattggaacacaggcctcctgcctccagtccagggctctttctactgaggagggacctgggatttaggaggcgcccccacctccccagctccagcctgagatgaaggccagattcttgtcagcaagtggaa

SEQ ID NO: 19478 - DNA, 3334 bp, Homo sapiens
gtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatcccctaacctgaatgtgtttacactgaaggtgtttttaaaatttattttaataatgtccatatgccttttaaaaatagtagtacatatatagaaaaacattgtccatagattctcaaaccccttgcagtaattccacagtcttcttggatctgagctatctgaggccagcccgatgcccttagtaccacatctggattatttcagacacataggtggagatagattctcttcacatgcaaaggagatgcttcagcttctatgccagcagtgccagcacttaggaattatgaccttctaatgaagttcttaaaattgcagccaagacccagatgaacatttggtttagtgttggcaaatcccaccagtacagtgtgatttaaaactcccacaatttgtggtgaagccaacataccaccatcctaggtgacccagggttggtcattgtgtttcactggacttcagcctcctgatctatatttgggacagggatgtcagtaaaaacgctgtttgatgagggaatgcccgtctccttacagagagaaaggtatatcagtgttgaaggtaagttctccacctgccctttctgcctgcatcagaatctttttatcccaaaacggtcaacagtgagctactccaagtgtggtccatagatcaccagcattgggatcatcttggggcttgttagaaatgcagaacccgggctgggcacagtggctcacacctgtaatcccaacgcttttgagttgctgtggtgggacggtcgcttgaggccaggagtttgagaccagcctaggcaatatggcaagaccttgtctctacagaaaaatttcaaaaagttagtagggcatggtggcacgcacctgtagtctcagttattcgggaggctaaggtatgatgattgcttgagcctgggagttcaaggttacagtgagctatgatagtgccactgcacttcagcttggactgaagatcctgtctcagaaaaaaaaaaaaaaaaaggcagaatcctaggttttgtcctgtcccaggcgtgttgaatcagaatctgcattttagcaaggtctccaggagatttgtatgcacattacagtatgagaagcactgccatacagaagagctgtatcagagttcagtgtgatccctgttattaatccaggttgctgaccccaccccagacctactgaatcagagtctcaggaaggagggcccaggaattttagttttattaaacattctagtttattctcctgtacactagtatgtcagaatcagcgtactagggaaaggaacacaaacccaacttcacgttttttcttcagatgctgtctgttattttggatgacacccctcctggccataagccagccattaggcacagagatgggtggatttaatttgaaaaggaactataattctataatgcacagtgtcctctcttagaatatctacactttctttcctttttttgattcttaaaaaaaaacttattgatacataatagatgtaaatattgtcagggtatatgtggtaatttgatatattcatataatcaatcagtgtaattgggatatccatcaccttaaacatttacctttatgctagtaacattcaaattactctcttctagctattttgaaatgtacagtagattagtattaactctagttaccctactgatctattgaacaccaggtcttacttcttctgtcttaactgtaattatcttcattttctagcaatgctatttctcatctctaacttgtatcatctcaggatgctgtatatttct

SEQ ID NO: 19479 - DNA, 1457 bp, Homo sapiens
aagcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtaaattagccttggaacgtcagtttcttcgtctctataattgaaataataatagtacctctctcaggattgttgtgagccgtcagtgaaacacttagagcagtttctggcacatggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaa

SEQ ID NO: 19480 - DNA, 837 bp, Homo sapiens
gcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaagg

SEQ ID NO: 19481 - DNA, 781 bp, Homo sapiens
ggaagggaaaagcagatggacctatacgggtaaagtggcttctgggcggaaggtacactataggctcggggaggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtat

SEQ ID NO: 19482 - DNA, 708 bp, Homo sapiens
gttactagaagggctccaggatggaggccgacctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtta

SEQ ID NO: 19483 - DNA, 705 bp, Homo sapiens
ctccccagggttccagagatggccaccagcctcggctctcccacgtctacacccatcacctccagcctgagggcgcaactgagaggaactgagacccaagcagctcagtaaaggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctccc

SEQ ID NO: 19484 - DNA, 1989 bp, Homo sapiens
cgcgcccgtggggccggagaggaagtaaacccgcgcgtccacctcggggacacccccgcgctcggtggcctttgtccggtgacgctgccagcgcccggagcaccaggggccgaaggggtccacagagcagccgcgggacccccggaaacccattgcgaccggccccaggagacccaccaccaggctcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccctctccgcgcgctgcggagaggccaacggtcgcgcgggtgacggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccattttgtatcaggtgtgttgctggccaggagctgatggctcactgggctcttggaggggaatgtgaagaaaccaaggagtcactttttcatctagattacttaggattccttgacttttcagaagtcgggaagcagtatgtttgcctgttgtagacctacttgctcacatgcagatttgagagga

SEQ ID NO: 19485 - DNA, 808 bp, Homo sapiens
caccaccaggctcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctccc

SEQ ID NO: 19486 - DNA, 774 bp, Homo sapiens
gcgcgctgcggagaggccaacggtcgcgcgggtgacggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctccca

SEQ ID NO: 19487 - DNA, 2399 bp, Homo sapiens
atgctccgggtgtcccggagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaggaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaatatttaatgctctcattgtgagggcatactcttaatatttattgagctccctgacttttcaagattgccatagaatatcttttgttttattttaatttggtttaggcatatttcataagtgcatgtcagcatgactgagcacatctgtacctttattatggtgaaagagttaatttgttattttaggcacatataccaacttttaaattggtcatattaccccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagactaacagtagttcccaaataaaggcacacaggagaaaatgaatcaatagaatctaattaaaattactactccagggaataagaagtattgaggatttattttattttgaattggttttaagtatggaataattgtctttacagttataaaaagtaattagtggtgtttacaaaatgttgggaatttctgctttgacagataggtaagtcccatgggaatttctgctttgacaaatagttaagtcccatggccttcagagaggcaggaagcagaaactttcaaaaaagtaacatttctctggatttaatgtggaaatagagaaaaatttaaagaataattaaaaaaccatggtagatgaaatttggtgattacatatagtttcggatgttaatgctagttgagagaagagaaaaagatagcaagtagaagcagagaacaggatcattggaagggacctgagaaattgccatttcatccattttagcaaatttaattagcatagcatgtaccagtactaggatcttgagtgagtgtgtgagtttagctctgcctaatatattactacttgggggatctttgggagactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgacttaaacaggcccagaatttagtttttcaaatcctagtagtgtgttttttctgtcttgccaaaaagcagcacacctcaaagaagggaaaaggtgtgaattgtgggtatattagggttattagtgcttccgagggaagataggcatcactacttcccagagatgcccctggaaatgatatagaggatgttgaagaattcaatgtgatgacggaatgaggcatttgtagtaatgctgagaacagaaaaatggactaagtggaaaatttgtaagcatgactttgaatgtagatttgttatgtgaacaaactacctagtttatttttagttcaatacaataattgttttaagaaaacatgaaataactactcaatataaaatgcattttaaaactgtaaataagtcaaaactttattctttttatcataatggtcactagctgagtcacaaatactagtacactcttctgagccatcttctttattcatatctacattgtgtggttaggcatctgttatgtggtgtcacatgataaaataaagaacttcttcccataccatt

SEQ ID NO: 19488 - DNA, 695 bp, Homo sapiens
agccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 19489 - DNA, 812 bp, Homo sapiens
gacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctgtgcgtgccccacccacccccaaccccccaccatcctcctgaggcctgggggccagaaccattgcaaatcttccctcccctcccttgtgctcacttgactttgccccctttgcatgtagcagaggcctcggttcccagcttgtttccattgcttccccagatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 19490 - DNA, 948 bp, Homo sapiens
tttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagt

SEQ ID NO: 19491 - DNA, 1388 bp, Homo sapiens
gaccagcgtcgacgctcaccttctcggcccgggctgtcaaggaagggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctga

SEQ ID NO: 19492 - DNA, 574 bp, Homo sapiens
gcagcaccatctgtcatggcggctgggctgtttggtttgagcgctcgccgtcttttggcggcacggcgacgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctg

SEQ ID NO: 19493 - DNA, 755 bp, Homo sapiens
agtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 19494 - DNA, 503 bp, Homo sapiens
ggttggctccggttgcagagttgagtgtcctgagaggtcagattgctgtcaggcagaagaacagcatcactaaaaacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatata

SEQ ID NO: 19495 - DNA, 462 bp, Homo sapiens
acgaccctcccaagatgctacctggtttacgagaggttccgggaccaccaacacaccggctaccgcctttccagaccaccctcgccagctcccgtctgtagtttccgcggccgaaggagaagaaaacccctcttcatctagcactttgcctcccccaaagacagcaccgccgcctacctgtcaccctgctgtctccggcttcctaccgccgccgcctcccgcagcagcctgccaactgcagcgcaacaaccaaccctctcattggacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgat

SEQ ID NO: 19496 - DNA, 547 bp, Homo sapiens
gagtgtcctgagaggtcagattgctgtcaggtgcttgttcccgcttctgccacacgcaaaattgtctttgtttgcctttggatcgcaaaggcagaagaacagcatcactaaaaacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 19497 - DNA, 541 bp, Homo sapiens
actgaggggtcagtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctc

SEQ ID NO: 19498 - DNA, 671 bp, Homo sapiens
gaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 19499 - DNA, 684 bp, Homo sapiens
gaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggtattgactgaatgtatgttcttgctgacctgtgtttttt

SEQ ID NO: 19500 - DNA, 713 bp, Homo sapiens
ttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtg

SEQ ID NO: 19501 - DNA, 1234 bp, Homo sapiens
gtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaa

SEQ ID NO: 19502 - DNA, 711 bp, Homo sapiens
ccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtc

SEQ ID NO: 19503 - DNA, 717 bp, Homo sapiens
gcgcgccgccggaaaggaaccctggtccggaggcggcggcgcagtgcatcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaacattttccccca

SEQ ID NO: 19504 - DNA, 411 bp, Homo sapiens
gcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttc

SEQ ID NO: 19505 - DNA, 598 bp, Homo sapiens
ccagaaacgagaacaacggaggcagaggagctgaagactccagtatgcaactgactacaaggagatgcagtttcacatacagctgggtactccaagtgtacagttcccatcagctctaatatgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatg

SEQ ID NO: 19506 - DNA, 761 bp, Homo sapiens
cctcccgagaagagtgacggggtggggctgtttcccgctcggaaactaagaaataaatgcctcatccctactccagaaacgagaacaacggaggcagaggagctgaagactccagtatgcaactgactacaaggaggtttgtgaggcttcagtatgatcgtgagtgtaagtgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 19507 - DNA, 628 bp, Homo sapiens
gagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtacatctctgcgccggatgtcatctaacagattccctggatcatctggatcaaatatgatttattatctggttgtaggcgtcacagtcagtgctggtggatattatgcttacaagacagtcacatcagaccaagccaaacacacagaacataaaacaaatttgaaagaaaaaacaaaagcagagatacatccatttcaaggtgaaaaggagaatgttgcggaaactgagaaagcaagttcagaagccccagaagaacttatagtggaagctgaggtggtagatgctgaagaaagtcccagtgctacagttgtggtcataaaagaggcatctgcctgtccaggtcacgtggaggctgctccgg

SEQ ID NO: 19508 - DNA, 809 bp, Homo sapiens
ctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttc

SEQ ID NO: 19509 - DNA, 1198 bp, Homo sapiens
aagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 19510 - DNA, 725 bp, Homo sapiens
cctcccgagaagagtgacggggtggggctgtttcccgctcggaaactaagaaataaatgcctcatccctactccagaaacgagaacaacggaggcagaggagctgaagactccagtatgcaactgactacaaggagacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 19511 - DNA, 1257 bp, Homo sapiens
aagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatatgcagtttcacatacagctgggtactccaagtgtacagttcccatcagctctaatatgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 19512 - DNA, 5211 bp, Homo sapiens
cacttccggcggaactgcgggtccaagttgtccttcccgcctccgggctgggccgacctcagctccgccctctggtcggctgacggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttacaattaggagataattaaaaatagataatttttttttttaatctaaggttgggtgtggtggcttacacctgtaatcccaacacttggggggccaaggtgggtggatcgcttgagcccaggcagttggagaccagtctgggcaacatggtgaaaccccatctctacaaaaaatacaaaaattagctgggtgtggtggtgtacacctatagtcccagctactcggaaggctgaggtgggaggatcacctgacccaggaggttgaggctgcagtgagccgtgattgcgccactgcattccagcctgggcaacagagcaagactttgtttcaaacaaacaaacaaaactatgttcacaatttatttgttttgtaatccttattcttttctgctttcactaaagactcagcccaagtataggatgccctttttccctttgttttttttttttttttgagatggagtcttactctgtcacccaaggctggaatgcagtggcatgatcttggctcactgcaatcaccacctccctgattcaagcgattctcctgcctcagcctccccggtagctgggattacaagcgcacgccaccacacctggctaatttttgtatttttagtagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcagtggctcacacctgtaagcccagcattttgggggttcaaggcaggaagatcagttgaggccaggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttacctcttagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcactttggcaggctgaggcgggcagatcattgaggtcaggagtttgagaccagcctggccaacgtggtgaaaccctgtctctactaaaaatacaaaaattagccaggcatggtggcacatggctgtaatcccagctactggggaggctgaagcaggaaaatcgcttgaactgagagtcaaggcggaggtcgcggtaagccgagatcacaccattgcactgcagcctgggtgaagaaacaagcctccctctcaaaaaataaataaataaataaataatacctcctctgggataa

SEQ ID NO: 19513 - DNA, 2631 bp, Homo sapiens
gacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtggcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgct

SEQ ID NO: 19514 - DNA, 2080 bp, Homo sapiens
atattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgt

SEQ ID NO: 19515 - DNA, 2394 bp, Homo sapiens
atattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctctta

SEQ ID NO: 19516 - DNA, 2371 bp, Homo sapiens
gagagccggcagatggggggcttttagccacggtctctggtctgatgaagcagaaaagaagatgaggatcagggggtcctcgggaacgctgtcacgaatcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgt

SEQ ID NO: 19517 - DNA, 569 bp, Homo sapiens
gacgtagtcttctgttgtccttgactgggcgccgcctcccgccccgccgcctcggaagcccctgagagccggcagatggggggcttttagccacggtctctggtctgatgaagcagaaaagaagatgaggatcagggggtcctcgggaacgctgtcacgaatgtaggcttgcagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctattt

SEQ ID NO: 19518 - DNA, 2373 bp, Homo sapiens
gagagccggcagatggggggcttttagccacggtctctggtctgatgaagcagaaaagaagatgaggatcagggggtcctcgggaacgctgtcacgaatcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaa

SEQ ID NO: 19519 - DNA, 2171 bp, Homo sapiens
atattgaataagcgacccggcctcctagggggtcgtcgtggtccagacagtttagcagaacagcctccgcggctccggggagaagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgat

SEQ ID NO: 19520 - DNA, 2042 bp, Homo sapiens
gccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 19521 - DNA, 2064 bp, Homo sapiens
aaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcct

SEQ ID NO: 19522 - DNA, 1232 bp, Homo sapiens
gcagccggagtaagatggcggcgctgagggctttgtgcggcttccggggcgtcgcggcccaggtgctgcggcctggggctggagtccgattgccgattcagcccagcagatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtaaggccccaatcctttcttggctgatattccagctagtttcccctgcctcactcttctctttgccacttccttctttaccctacttctcagtgtctgtgggagctcttgtgtgtgttagacgaggttgctctcaaaacactttcacatatatggaatcttacttatttttttcttttttgagacggagttttgctcttgttgcccaggttggaatgcaatggtgcaatctcggctcactgcaacctccgcctcctgggttcaagtgattctcctgcctcagcctcctgagtagctgggattacaggcatgagccaccacgctcagctaatttatgta

SEQ ID NO: 19523 - DNA, 875 bp, Homo sapiens
aagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggaggtaagctaggagtcaatgggaaaaatctctcccccacaagaagggctagagaaatacagagatatttgaagagtgtgaggaagagtattaacacaccagttttcttgatcaatagttgctgaccaacaataggatctggcgaaatcggacaattgacattggggttgtaacagcagaagaagcacttaactatggttttaggtgaggggaata

SEQ ID NO: 19524 - DNA, 958 bp, Homo sapiens
acacttccgtttccggtccgtgcccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 19525 - DNA, 673 bp, Homo sapiens
tttcatcctggcgtttgcctgcagcaagatggcggcggtgtcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactaca

SEQ ID NO: 19526 - DNA, 544 bp, Homo sapiens
atcctttacggcaggcgtccgcgtcgctagctagtcgttctgaagcggcggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctatttgttctattttctcttgga

SEQ ID NO: 19527 - DNA, 548 bp, Homo sapiens
atcctttacggcaggcgtccgcgtcgctagctagtcgttctgaagcggcggccagagaagagtcaagggcacgagcatcgggtagccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctatttgttctattttctcttgga

SEQ ID NO: 19528 - DNA, 1082 bp, Homo sapiens
aaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgacaatttgtaagtttgtttctttcatagtctgggctttggaagtgaacatccacgtggacatgggtagacatgcgagtggaagcagtgcccgctccagtgagcctgagctgcctcctgccggccgctgcctgccttaccggctgcttctgtgtgtctcctcttatccttggggccacgtgggctgcaggaatgggcggggggcagggaaggagaaggagaagtgcctcttgttttgcagatgcaactgtgcttcagagagccaaggtgggtcttgaggtgcatagtgaaggagggtgcccaggcctcaactggtcctatgggaaggtcagcctctctcctgttgctggcttgcagagctggtctatccgtccgtcctagtccctatgttgaaatgtcagatcttaaaacccaagaatttaagcactggtttgaaggcatcgaaagtcacatactggccacattaaggacagtctatgtttttaaaagagtaaggattataatgtagtgtaacataaaaataaaagtagattttgagggaagagaaaggagtcttgcta

SEQ ID NO: 19529 - DNA, 1034 bp, Homo sapiens
gggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 19530 - DNA, 2818 bp, Homo sapiens
gttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgcc

SEQ ID NO: 19531 - DNA, 3871 bp, Homo sapiens
gttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccgggtgagtactatgagctgtaggccctcctcgagcgccagggcctctctgcacactcacaggcacacacatacacacaccaacgtgcagacacgtacacacacaacacatgcatgcacactcacatgcgcacatgtgcatgcaagctcacatgtatggacagatgtgtacacggaccacacgcacactcacgcacacaatgcacatatgcacactcgcacacatgcacacttgcacacacatgcacacacaagcacatgtgcacacacgcttgcacacatacacacatgcacacttgcactcatgcacactcatgcgcacatatacacatgcacacgcacactcgcacacacgtgcacatatatgcacagtcatgcacacacatgcacactcacacacatgcacacacgtccttgtgtggacacatgcatgtgtgcctgttggcatgcatgcacacaggcacactcactgatgcacacacacccctgcggccgtggagcagggcggaccctcccggaggcccctgtgctggcctggtggcctgtggttccatctgaggattcggaccctgctggagatgacccctccgtttccgtcattctctttctggcgtccgtgtgttcctcttgtttctcttttaaggtgaaagcagtgttttaagttaaaaggagcgcgtgtgaaggcagtagatccttctcggtacccgtttaaagcctcccctgcctgtggcgccagcccccacgcagcccctgccatccccctgcagcgtgagcacgtgcagctccctccagctcctgcggcacttgctgcgacagcccgggttcaacaatcccccattgatggacgttcactgtttccttttgttttttgtttcctaaacaatgccacggcgaacgtcctgccagggccgcagtggtcgagacaaggatagtttttaatgcaggatagttcttttctttttcttttcttttcttttttttttttttgagacggaggctcgctctgtcgcccaggctggagtgcagtggtgcgatctcggctcactgcatgctccgcttgccgggttctcctgcctcagcctcctaagtagctgggactacaggtgcccgccaccacgcccggctaattttttgtatttttatttttagtagagatggggtttcaccgtgttggccaggatggtctcgatctcctgacctcgtgatccgcccacctcggcctcccaaagtgctgggattacaggcgtgagccaccacgcccggctaatgcaggatagtttctaatggagggaacctgagacatggccagcggccgtcccaacacaggcttctggcgggcaggtggacctggccatttctgcccgggcagccctgcctcactctgtagcctgaccctgtcacccgccaacacatgcagcagggcccctgccaggtctcagagccgcgtgcagggagagcgggaacggtgggggaaatgagaagccacagggatggaggagaggggagggagtggccaaggagatctgagagggcttcctggaggcgtcgcacttggtatgtggacccagatctagttaacgcagagagttcccggttagacctgcgctactactcgcctgtagcccacgcgctcagagagtggctggagccccctgttgaaatggtgggacttaggatacactgggttcgaggaactatgtgatgaggacagatctcacccgtttctctctattttatgtatttgaatgtggctggtggggcgcgctttacaactcttggggcccggaggccacctgcaggagccgctgtgcctctcacctctgccggctgccgccccgggacatgagtcgggggttctgggtgctccacgtggagtctcacgctgggccacgcggggctccgggggtggcgtctgacccgagcccggcctccgcagagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 19532 - DNA, 754 bp, Homo sapiens
gaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaagtcttccctacgaccagatgccggagccgcgctacgtggtctccatggggagctgcgccaacggaggaggctactaccactattcctactcggtggtgaggggctgcgaccgcatcgtgcccgtggacatctacatcccaggctgcccaccacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcctccc

SEQ ID NO: 19533 - DNA, 1060 bp, Homo sapiens
tttgtaaggtctcccagggcgccggagcgcagtgtcgtctctgtggcgcaatcggttagcgcgttcggctgttaaccgaaagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagca

SEQ ID NO: 19534 - DNA, 791 bp, Homo sapiens
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 19535 - DNA, 620 bp, Homo sapiens
ctacagtgtagcctccgcctcccgattgactggcctgcttggcaaggcaagtagcggcggcgcttcaagggacggggttccaccatgttagccaggctggtctcaaactcctgacctcaggtgatccacctgcctcagcctcccaaagtgctgggattacaggcgtgagccaccacacccagccctagcgagtcactcaacaaactgagtcccagcgccttatttgtgcctccctcgtggagtccttatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccagg

SEQ ID NO: 19536 - DNA, 515 bp, Homo sapiens
ggaaggtgctgggttgggtccctggaactgcagtcagtgatccaaaggagtgggcctgttagggggttcacaggtcgtgggatgagctcttatgagcgccggctaagtgccgggctctggggtgcccttggcatgtacgggctcccctaattcccaagaccaaccgcccccaacccacttcatagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgt

SEQ ID NO: 19537 - DNA, 689 bp, Homo sapiens
cacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaa

SEQ ID NO: 19538 - DNA, 353 bp, Homo sapiens
gattgactggcctgcttggcaaggcaagtagcggcggcgcttcaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccga

SEQ ID NO: 19539 - DNA, 1596 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctgg

SEQ ID NO: 19540 - DNA, 1512 bp, Homo sapiens
agttcctcagcctcagtgctatgaaggtgacagcgtgaggtgacccatctggcccgccgcgatgctggcaacacggcggctgctcggctggtcgcttcccgcgcgggtatctacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 19541 - DNA, 1131 bp, Homo sapiens
agtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcagccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcc

SEQ ID NO: 19542 - DNA, 1503 bp, Homo sapiens
cgccagttcctcagcctcagtgctatgaaggtgacagcgtgaggtgacccatctggcccgccgcgatgctggcaacacggcggctgctcggctggtcgcttcccgcgcggacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgccca

SEQ ID NO: 19543 - DNA, 1493 bp, Homo sapiens
gcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcc

SEQ ID NO: 19544 - DNA, 930 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagttatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgtaaactta

SEQ ID NO: 19545 - DNA, 1045 bp, Homo sapiens
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgagtatcaataa

SEQ ID NO: 19546 - DNA, 1575 bp, Homo sapiens
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccaggggacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaagg

SEQ ID NO: 19547 - DNA, 985 bp, Homo sapiens
agactatgctccaggaagcccaggtgtttcgaggacttgcttctacggtttctttgtctgcggaatcagggaagagtgaaaagggtcagccacagaattccaagaagcaaagtccaccaaaaagtgtccctacaccacaccgaagatactcaccttgtggagattggaaggatgccagctctttaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctg

SEQ ID NO: 19548 - DNA, 1734 bp, Homo sapiens
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttg

SEQ ID NO: 19549 - DNA, 1679 bp, Homo sapiens
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaaagcctgcgcaaatgctgtcaccgatattccagtctggatcctagaaaggttcaattctacttcaacaaagaaaatttttga

SEQ ID NO: 19550 - DNA, 1584 bp, Homo sapiens
atgggaaactgggtggttaaccactggttttcagttttgtttctggttgtttggttagggctgaatgttttcctgtttgtggatgccttcctgaaatatgagaaggccgacaaatactactacacaagaaaaatccttgggttttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttga

SEQ ID NO: 19551 - DNA, 785 bp, Homo sapiens
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccatccccatataacaccaacagtgtacatgtttactgtcacttttgatatggtcttatccagtgtgaacagcaatttattcttatttttgctcatcaaaaaataa

SEQ ID NO: 19552 - DNA, 661 bp, Homo sapiens
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccatccccatataacaccaacagtgtacatgtttactgtcacttttgatatggtcttatccagtgtgaacagcaatttattcttatttttgctcatcaaaaaataaaggattttcttc

SEQ ID NO: 19553 - DNA, 2529 bp, Homo sapiens
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaataaaggattttcttcttcacttga

SEQ ID NO: 19554 - DNA, 695 bp, Homo sapiens
cttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaaagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcag

SEQ ID NO: 19555 - DNA, 2042 bp, Homo sapiens
caaagacaaaataatttactagggaagcccttactaacgacccaacatccagacacaggtgagggagaagaaatttcctgacagccgaagagcaacaagtatcatgatggggtgctggattttgaatgagggtctctccaccatattagtactctcatggctgggaataaatttttatctgtttattgacacgttctactggtatgaagaggaggagtctttccattacacacgagttattttgggttcaacactggcttgggcacgagcatccgcactgtgcctgaattttaactgcatgctaattctaatacctgtcagtcgaaaccttatttcattcataagaggaacaagtatttgctgcagaggaccgtggaggaggcaattagacaaaaacctcagatttcacaaactggtcgcctatgggatagctgttaatgcaaccatccacatcgtggcgcatttcttcaacctggaacgctaccactggagccagtccgaggaggcccagggacttctggccgcactttccaagctgggcaacacccctaacgagagctacctcaaccctgtccggaccttccccacaaacacaaccactgaattgctaaggacaatagcaggcgtcaccggtctggtgatctctctggctttagtcttgatcatgacctcgtcaactgagttcatcagacaggcctcctatgagttgttctggtacacacaccatgttttcatcgtcttctttctcagcctggccatccatgggacgggtcggattgttcgaggccaaacccaagacagtctctctctgcacaacatcaccttctgtagagaccgctatgcagaatggcagacagtggcccaatgccccgtgcctcaattttctggcaaggaaccctcggcttggaaatggattttaggccctgtggtcttgtatgcatgtgaaagaataattaggttctggcgatttcaacaagaagttgtcattaccaaggtggtaagccacccctctggagtcctggaacttcacatgaaaaagcgtggctttaaaatggcgccagggcagtacatcttggtgcagtgcccagccatatcttcgctggagtggcaccccttcacccttacctctgccccccaggaggactttttcagcgtgcacatccgggcagcaggagactggacagcagcgctactggaggcctttggggcagagggacaggccctccaggagccctggagcctgccaaggctggcagtggacgggccctttggaactgccctgacagatgtatttcactacccagtgtgtgtgtgcgttgccgcggggatcggagtcactcccttcgctgctcttctgaaatctatatggtacaaatgcagtgaggcacagaccccactgaagctgagcaaggtgtatttctactggatttgccgggatgcaagagcttttgagtggtttgctgatctcttactctccctggaaacacggatgagtgagcaggggaaaactcactttctgagttatcatatatttcttaccggctgggatgaaaatcaggctcttcacatagctttacactgggacgaaaatactgacgtgattacaggcttaaagcagaagaccttctatgggaggcccaactggaacaatgagttcaagcagattgcctacaatcaccccagcagcagtattggcgtgttcttctgtggacctaaagctctctcgaggacacttcaaaagatgtgccacttgtattcatcagctgaccccagaggtgttcatttctattacaacaaggagagcttctagactttggaggtcaagtccaggcattgtgttttcaatcaagttattgattccaaagaactccaccaggaattcctgtgacggcctgttgatatgagctcccagttgggaactggtgaataataattaactattgtgaacagtacactataccatacttccttagcttataaataacatgtcatatacaacagaacaaaaacatttactgaaattaaaatatattatgtttctc

SEQ ID NO: 19556 - DNA, 2388 bp, Homo sapiens
tgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaa

SEQ ID NO: 19557 - DNA, 3347 bp, Homo sapiens
attctctgagcgtgcacgggtgggaagctggaagtggaagttttgtcttaattcgaacattctcaacttacaaaactttatgctggagataacaatgaacactccccctcccaccccctcgcctgtcccccaaatgcatgagaatttttctgcacattgatgggagagatgtggaggaagagggaagaggtcattttccgtgaatacagcttttctttttaccctttaaacatttttgctccctttgttcttttcccagattacttctgtttgcttgggttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgcaagcactccaggcaaatatattagatgtttgaaaacacagcacaagactctgtattgatacgggtactttgtgtcaatatctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatatggatatatatatgtatatacacatatatatatacacacacacacacatatatatatatatatatatatatacacatatactaataacttttcccttttttcagcatttttgtctctattattattattgtttttttcccaggtagggtttgtcttaggctgtagcctctaaggatagttagttaatttgcactttgagaccaaaggacatcatgtgtgtcagtagggactgaatataagatttatctcctttgccacacattggtttatgatggagacattgaaagtctagtcatattcctgaacagtaaaacctgtattttaccttttaagtaagaggaaatatgatattcttattcaaacttaagtttagaatccagaatattactgtcgcactttttggtatcctgagtttccatagggaactattgggtttaaagtcaccgttggaactacactgtgtgatcttataaacttatgttccctggctatcatattcttggctcagaacaatatttcccattactatcttaagaattaaggcattcatggctcacgcctgtaatcccggcactttgggaggccaaggc

SEQ ID NO: 19558 - DNA, 816 bp, Homo sapiens
atggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 19559 - DNA, 560 bp, Homo sapiens
cctagacaaaggggccggcgcggcggagcagactggtgcagcctgggccgcgcgctcagagcgctgggcgtctgggcagctgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttgggggaactgtcttgaaacctatacatttcagatgggcacccagagagtaagacctcacctcgcccctcaagttgcttacaatataatggaa

SEQ ID NO: 19560 - DNA, 1825 bp, Homo sapiens
acattgatgggagagatgtggaggaagagggaagaggtcattttccgtgaatacagcttttctttttaccctttaaacatttttgctccctttgttcttttcccagattacttctgtttgcttgggttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagca

SEQ ID NO: 19561 - DNA, 4184 bp, Homo sapiens
tgcagtgtcgaataggtacctgggtcaactccacacacttctcactcttcactggacctctggtacaagattgagaggattcctattacttacaaacagactagttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgcaagcactccaggcaaatatattagatgtttgaaaacacagcacaagactctgtattgatacgggtactttgtgtcaatatctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatatggatatatatatgtatatacacatatatatatacacacacacacacatatatatatatatatatatatatacacatatactaataacttttcccttttttcagcatttttgtctctattattattattgtttttttcccaggtagggtttgtcttaggctgtagcctctaaggatagttagttaatttgcactttgagaccaaaggacatcatgtgtgtcagtagggactgaatataagatttatctcctttgccacacattggtttatgatggagacattgaaagtctagtcatattcctgaacagtaaaacctgtattttaccttttaagtaagaggaaatatgatattcttattcaaacttaagtttagaatccagaatattactgtcgcactttttggtatcctgagtttccatagggaactattgggtttaaagtcaccgttggaactacactgtgtgatcttataaacttatgttccctggctatcatattcttggctcagaacaatatttcccattactatcttaagaattaaggcattcatggctcacgcctgtaatcccggcactttgggaggccaaggcaggtggatcacgaggtcagagttcaagaccagcctgaccaagttggtgaaaccccatcgctactaaaaatacaaatattaggcgggtgtggtggcgggtgcctataatcccaactactcgggagactgaggcaaagaatcgcttgaacccggtgggcggaggttgcagtgagccaagattgcaccactgcactccagcctgggtgacagagcaagattccatctcaaaaaaaaaaaaaaaaaaaaaaaaaaagaattaaagcattcatacagtttagtgattttgtttagtagtcggctatcaattgctatcaaatataacactgctgaaatcagcagtgtgacttaccttgccattgttaaaatgttacataaaacataacatgatagatgctaaggcctttttttgctataattcaccaatagcaatcaagcatgctaacccatactgaatgatatttacttgtagatatttcttcctttccttgaaattctcctttctatggaaagaagatgaacccaaaaaagtgataggaaatgtggaatgctcatgcagatttagctctgaaggcatatttaataactagtatgtcttgacaacagtctttagattaaaaagaattttcatggaaacatttaacagaaagaactagtaaaaagacactttgagttagtccaggcttaatgtgcaatactgactctatactgatcataatttatttatgcgatcatattaatagacctaatttcattaaaacaggtagaagatttttcaaaagaaagatgatgtttcaaagctggtctgccattctagatgagcctccttgcttatttaagttccagtaggtgttcaaatgttaaatgttaaacataggtcatctttgcttctgcagggcttcatcttgcatgtttaagagaactttgttttattttgagggattatttctctggggatcattcttataatacaagccttaaatcactaattttagtagcaataaatgttaaaattg

SEQ ID NO: 19562 - DNA, 2379 bp, Homo sapiens
tacttctagtctagttggagaaacaacctagaaaatgcaccaacaaatggggcacaataactactctgagagagagtggcacacagtggacgcaaagaagaggttcctgatgcagctgggaagagtctacatgggcctctagcaggagaagatactggtcttgagtttggagactaagtaagcatctccagtgtcgaataggtacctgggtcaactccacacacttctcactcttcactggacctctggtacaagattgagaggattcctattacttacaaacagactagttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctg

SEQ ID NO: 19563 - DNA, 696 bp, Homo sapiens
atggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggtgtccaactgaaaccaaagcaacatttggggttcatcttaaaatagtaggagactggacagaacgatttcgagatttactactgcctccatctagtcaagactccgaaattctgcccttcattcaatctagaaattatcccaaggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 19564 - DNA, 2156 bp, Homo sapiens
acaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaaggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgca

SEQ ID NO: 19565 - DNA, 4376 bp, Homo sapiens
tgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgcaagcactccaggcaaatatattagatgtttgaaaacacagcacaagactctgtattgatacgggtactttgtgtcaatatctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatatggatatatatatgtatatacacatatatatatacacacacacacacatatatatatatatatatatatatacacatatactaataacttttcccttttttcagcatttttgtctctattattattattgtttttttcccaggtagggtttgtcttaggctgtagcctctaaggatagttagttaatttgcactttgagaccaaaggacatcatgtgtgtcagtagggactgaatataagatttatctcctttgccacacattggtttatgatggagacattgaaagtctagtcatattcctgaacagtaaaacctgtattttaccttttaagtaagaggaaatatgatattcttattcaaacttaagtttagaatccagaatattactgtcgcactttttggtatcctgagtttccatagggaactattgggtttaaagtcaccgttggaactacactgtgtgatcttataaacttatgttccctggctatcatattcttggctcagaacaatatttcccattactatcttaagaattaaggcattcatggctcacgcctgtaatcccggcactttgggaggccaaggcaggtggatcacgaggtcagagttcaagaccagcctgaccaagttggtgaaaccccatcgctactaaaaatacaaatattaggcgggtgtggtggcgggtgcctataatcccaactactcgggagactgaggcaaagaatcgcttgaacccggtgggcggaggttgcagtgagccaagattgcaccactgcactccagcctgggtgacagagcaagattccatctcaaaaaaaaaaaaaaaaaaaaaaaaaaagaattaaagcattcatacagtttagtgattttgtttagtagtcggctatcaattgctatcaaatataacactgctgaaatcagcagtgtgacttaccttgccattgttaaaatgttacataaaacataacatgatagatgctaaggcctttttttgctataattcaccaatagcaatcaagcatgctaacccatactgaatgatatttacttgtagatatttcttcctttccttgaaattctcctttctatggaaagaagatgaacccaaaaaagtgataggaaatgtggaatgctcatgcagatttagctctgaaggcatatttaataactagtatgtcttgacaacagtctttagattaaaaagaattttcatggaaacatttaacagaaagaactagtaaaaagacactttgagttagtccaggcttaatgtgcaatactgactctatactgatcataatttatttatgcgatcatattaatagacctaatttcattaaaacaggtagaagatttttcaaaagaaagatgatgtttcaaagctggtctgccattctagatgagcctccttgcttatttaagttccagtaggtgttcaaatgttaaatgttaaacataggtcatctttgcttctgcagggcttcatcttgcatgtttaagagaactttgttttattttgagggattatttctctggggatcattcttataatacaagccttaaatcactaattttagtagcaataaatgttaaaattg

SEQ ID NO: 19566 - DNA, 2610 bp, Homo sapiens
acacttcactcaaatggctggctgcagctggtgctagttatggtctgggatctcagatgaggctgctaagccgaatgtgttgttactcctttacatcgtctctccacatggcttgaacttctcacagcatgcctgctggattcgaagagatggcattcaagtgcttaaaaatcaagaagaccctcaccaggtgccagcgtctagacattggattttccagcctccagaacttacttctagtctagttggagaaacaacctagaaaatgcaccaacaaatggggcacaataactactctgagagagagtggcacacagtggacgcaaagaagaggttcctgatgcagctgggaagagtctacatgggcctctagcaggagaagatactggtcttgagtttggagactaagtaagcatctccagtgtcgaataggtacctgggtcaactccacacacttctcactcttcactggacctctggtacaagattgagaggattcctattacttacaaacagactagttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctg

SEQ ID NO: 19567 - DNA, 2277 bp, Homo sapiens
gagtgctacggacgacgcctatgaagcccttagtccttctagttgcgcttttgctatggccttcgtctgtgccggcttatccgacaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtc

SEQ ID NO: 19568 - DNA, 2804 bp, Homo sapiens
agcagtctttctgggacctgtgatctagaagacaggagaagatgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcattgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctacaaaaagtgagaagaatcatacagtgaacagtgttaccta

SEQ ID NO: 19569 - DNA, 2289 bp, Homo sapiens
agtctttctgggacctgtgatctagaagacaggagaagatgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccat

SEQ ID NO: 19570 - DNA, 7946 bp, Homo sapiens
atggacaacgccctgttttgtcttgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtttaacagcacccgttcgccctcccccactgaatgttgccacatgaccccgtggagtagaaagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaatt

SEQ ID NO: 19571 - DNA, 8761 bp, Homo sapiens
ggtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaattaaa

SEQ ID NO: 19572 - DNA, 8213 bp, Homo sapiens
ctgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtttaacagcacccgttcgccctcccccactgaatgttgccacatgaccccgtggagtagaaagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaa

SEQ ID NO: 19573 - DNA, 1108 bp, Homo sapiens
cccgagctgcaggtgtgcgtgttctgccggaacaacaaggaggcgatggcgctctacaccacccatatcctcaagggccccgacgggcgagtgctgtgtcccgtgctgcgccgctacacgtgtcccctgtgcggcgccagcggcgacaacgcgcacaccatcaagtactgcccgctctccaaagtgccgccgccgcccgcccgcccgccgccccgcagcgccagggacggcccgcctggcaagaagctgcgctgaaggcccgggctcccggccgcccagggtcgccgccgcccctcgcaccgctaggtctgcgcaccatctcgcccccgccgtggggaggcgtgcggctcagcggtcggctcgacatgggacgtcgtcctggtggtttttgaaaagcagccgaccgtgtggagtacttccgtgctgaacgattgggactagacgctgaaatccccatttgtcttcagtttctagtttgcacatccagaacggcgaaggctgggtgtgtattccactaactgaaatatggcaacttagaggcgctgtttatttactgtatacgtcgacctattttagatgcgcatcagtatgaaattgtctcaatcttggatgtttcattttatgaatggaggcactttactaggtctagaatatttttttaaaagcctctgaactgagcttaaaactggcgattttatgaaatgtcggcaaaatgactattttattgtttgaagcgagttaatattctcagttgtctttaaaaatcagttactctaattccaggtgaagcaagccgctggtagcatcacccttatgagaagtgaaggttttgtaaactttccagtattaatttgggcgggtattccccgcttgtggcttgtttctgtcctagctggaggtgtaaaatgcacaatgtgtagcaggtagaatacagctccttatcgttctatgtaccaggtattttattactgaactagcaactagccttttccacctttaaaagttgtgccaagtcataatcatattgtgtataacttggaaatggtgctgtttaaaaaaattgtgtatttatacagtaacagtatgaattcattaatctcacctgtaa

SEQ ID NO: 19574 - DNA, 4627 bp, Homo sapiens
ggcaggccggcgggcaggctcggcgtgtcccttccgtccggcccgcgccggcggcggggaggcggcgcgcggcccgcagcccgcccatggaggctttcccctgggcgccccgctcgccccgccgcggccgcgcccccccgcccatggcgctcgtgcccagcgcccgctacgtgagcgccccgggcccggcgcacccgcagcccttcagctcctggaacgactacctggggctcgccacgctcatcaccaaagcggtggacggcgagccgcgcttcggctgcgcccgcggtgggaacggcggcggcggctccccgccctcctcctcctcgtcgtcctgctgctccccccacacgggggccgggcctggggcgctggggccggcgctggggccgcccgactacgacgaggacgacgacgacgacagcgacgagccggggtcccggggccgctacctggggagcgcgctggaattgcgcgcgctggagctgtgcgcgggccccgccgaggccgggctgctggaggagcgcttcgccgagctgagcccgttcgcgggtcgtgccgccgccgtgctgctgggctgcgcgcccgccgccgccgccgccgccaccaccaccagcgaggcgacgccgcgcgaggagcgggccccggcgtgggcggccgagccccggctgcacgcggcctccggggcggcggccgcccggctgctgaagcccgagctgcaggtgtgcgtgttctgccggaacaacaaggaggcgatggcgctctacaccacccatatcctcaagggccccgacgggcgagtgctgtgtcccgtgctgcgccgctacacgtgtcccctgtgcggcgccagcggcgacaacgcgcacaccatcaagtactgcccgctctccaaagtgccgccgccgcccgcccgcccgccgccccgcagcgccagggacggcccgcctggcaagaagctgcgctgaaggcccgggctcccggccgcccagggtcgccgccgcccctcgcaccgctaggtctgcgcaccatctcgcccccgccgtggggaggcgtgcggctcagcggtcggctcgacatgggacgtcgtcctggtggtttttgaaaagcagccgaccgtgtggagtacttccgtgctgaacgattgggactagacgctgaaatccccatttgtcttcagtttctagtttgcacatccagaacggcgaaggctgggtgtgtattccactaactgaaatatggcaacttagaggcgctgtttatttactgtatacgtcgacctattttagatgcgcatcagtatgaaattgtctcaatcttggatgtttcattttatgaatggaggcactttactaggtctagaatatttttttaaaagcctctgaactgagcttaaaactggcgattttatgaaatgtcggcaaaatgactattttattgtttgaagcgagttaatattctcagttgtctttaaaaatcagttactctaattccaggtgaagcaagccgctggtagcatcacccttatgagaagtgaaggttttgtaaactttccagtattaatttgggcgggtattccccgcttgtggcttgtttctgtcctagctggaggtgtaaaatgcacaatgtgtagcaggtagaatacagctccttatcgttctatgtaccaggtattttattactgaactagcaactagccttttccacctttaaaagttgtgccaagtcataatcatattgtgtataacttggaaatggtgctgtttaaaaaaattgtgtatttatacagtaacagtatgaattcattaatctcacctgtaactttcctacttggcattttctctacacactcaccctcttccagttctttaaaaacgtttatgatattaagatcaaagggaggaagggaagacagcagtattaattcaccctagattactcaatttcagggttcctagtggaggaaagcccattccagctgttgcctgtcaaacaaatagaagatggatctctagctctgagctattcgtgtattaactcgtattcaagaaggttccaccgtgggctgcgtctgactttaatacaggcagtgctcaaactagaataagcactaattaaaggaattgttgggggtccttcatgtgttcccactcctactggaagacccatgtcggtttccggaaccccaccagtttacccataagcaagactaaacctgatccttgggcaaaagttcctaacccctactttaccctcccaccctcacttttaaatccaccatactgaatgccacactatggaatgcagctacctgccaagcaaggcaatagaaggcaaaaaatggaagtgaattaagatgaactcatctgaaatacacaaatgcattactatctgaagataccagcaagagtttagtctacgtgtataaggctcccagtaggatttagctaggctactagaagttagactgctttcgcattaaacagctaacttcatccacagcaaattgactcaatcaggaaccttcatttgaaggtgtgttagaggatggggtaaatacccgatagctgtctttttggtgaaagaaaaggtgcatttcaagaacttggggggcaggaggaaagcacaatgtttcttagccaggaaagacaaataatccaacgctgctagtcttaaccccagaccagagagaactgcagatctgactgggcctaaattaagtagcttaatgaaaccatgtaattacttgttctcctttcttttgctatagaaaatctaccagtttaaatgagcttcaccttctgggtgaagtttctaaggtcaacatgaatcctcttacctctctcactgctcgtgttctgccttttcaaaaggaccactatgaacagatcagcgcattctctaggccaaaagggctagccaggtggcaagatcaatttagctactttgtattttcagagtcaaattacagacggtttccaaaggtcttgagcatggggctttggcatagcctcaatatatgggagtcactgtgatgagatgtgcctaatgttaatttgatattctgacattgctattttaccagaactaagaacatattgagctggagcttcttgagggcaggagagtattggaaaaggaatccagaagaccctctccactactcaggcagccactattcatctatttttaaagtaccccattttcaggccgggtgtggtggctcatgcctgtaatcccagcactttgggaggcgaggcgggggtggatcacaaggtcaggagaccagcctggccaacatggcgaagccccgtctctactaaaaatacaaaaattagccgggtggtgtggtgggcgcctgtaatcccagctcctcaggaggctgaggcaggagaattgcttgaaaccaggaggcggaggttgcagtgagcccagatcacgccactgcactccagcctgagcaacagagcgactctgtctccaaaaaagaaaaaaagtaccccatgttcagcccctgtgccaaatttgcctaggttttccagctgacaatgaatactgggagttaaaacgcagagtattactatagttaattttctagggttctcttatgaaaagtatatgtaaacacattcatttaaaaatccttggaactcaatgtggaactttaaacattttgcaaaattacatttagagaaacccaatttttcaaagtttaagaaatatacaaagtatgacaaaattatcttcataagaacatgctgcatacttgcctagtagcaaaacaatacagggaagagtcaaaagggcttctccaactgtagaggtacagattgtcttaacctgttcttttctgtacagacttaaaatttctagtggcttttatttttctttgtattttaattttcctacaaagtcctttttggaagttgcagaattattagctttgatgagaacaacttttgtcatagatttgatttattaaaccaaaattatacatattaaaattatatcacaaatatatatgcttccagacaaagaaaagtttgttagtcctgattttctaatcgtagccactcaaggaacagtcctttcatagtaccccaagtatttcaattagacttataaaagtataagtcaatctatggtcagtgtctttggttaaaaaaaaaaaaaaacacaggcagttctttacataaaaacgtcccacacgttatagatgccagccacctcctggtagtcactatggacaactaatgagatgcaaagtcttttggaccgatgatgtctctactactggatctatctgtattaacagcaatgttactctcaatgaaactgcagaagccaccatgaacatggaagaccacctagcagatcggtgagtaggctgcttgttcagctttcctttaacacctgttggtaaatactaatgggagtagacagagttgtatggcctggacagtggaaaccaagagcaggatcgcaaagtaacagcatcagactcttctgccctcctcttgcacttgggttctgactcccagaacaaagaacttgggagaacagtacgggagactgagcagaaaggatgggtttgctgactcgccttgaaatctaactctaacgtaggcag

SEQ ID NO: 19575 - DNA, 3691 bp, Homo sapiens
agtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaat

SEQ ID NO: 19576 - DNA, 3895 bp, Homo sapiens
agtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaat

SEQ ID NO: 19577 - DNA, 3375 bp, Homo sapiens
gcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttggttctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctg

SEQ ID NO: 19578 - DNA, 1660 bp, Homo sapiens
gaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttggttctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaat

SEQ ID NO: 19579 - DNA, 3380 bp, Homo sapiens
aagaatgaaggtttctttgaggaacgcagcctgaatgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctg

SEQ ID NO: 19580 - DNA, 2557 bp, Homo sapiens
actgggttgggggaggggttcaggcctgttccccgcggctgcggcagcaccagggccggccgccaccgcctctagaacgcggaggagatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagttctatgtcaatgggcccaggattctgaaacatagtccatgttgtcataaaggccacagcctagttgggtaaaccaacactgaacaattaagtttgatccagttgggaaactgtattatgggtaaacagattgccaagagagccagaacagaatctatggatttcctgaaatatgttgttgacaaactaaacttcaagcctctgga

SEQ ID NO: 19581 - DNA, 3574 bp, Homo sapiens
ctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcaattgtatcatccccattactgatatcagggctttcacaacaacactcaaccttctcccctaccataaaatagtcaaataaataaactgcagtcacgttggcctg

SEQ ID NO: 19582 - DNA, 3640 bp, Homo sapiens
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 19583 - DNA, 2914 bp, Homo sapiens
gtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaataccaaa

SEQ ID NO: 19584 - DNA, 672 bp, Homo sapiens
tgccgtcaccctctcacggccctcttcagcccctggcttcctcccccaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgtgagtcccgccccgggcctgcccccaacagatgccctcttgcggccccaccctgggccagcgccggcaccccaggtccccagggtgctgtggcgctgctggctctgacgcagccttgatgtggccttgtggcctgtgtctgtccccaggaccatgagcacgcaaccttcgaggacatccttggtatgtgcctcattggccttctctctgctggttccaggcctgggaggggcagacacaggtgggggtgcccctggggctggggtggggg

SEQ ID NO: 19585 - DNA, 1838 bp, Homo sapiens
acgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggccgggcttggaacgatgtacgataccctcatagtgaccattaaacct

SEQ ID NO: 19586 - DNA, 3556 bp, Homo sapiens
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 19587 - DNA, 3571 bp, Homo sapiens
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 19588 - DNA, 3646 bp, Homo sapiens
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 19589 - DNA, 2888 bp, Homo sapiens
tctggagttgaaggggagccctggaaggctgtcgcgggaagagcactgggtgggatttgcctttgggtgggaggtggtgccaggagccagggagagcactggcttcccacaccgaaggggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagtaggtgccccgcacaggcccgcccaccttccccagagcctcccctagaccccagacccctgctgggggtcccctgccagggccgctgggctgcgcttttgcactcctgaatcttggtttacctgtttgtgagatggggacgccctcagcatctccgatcgcaaaggcggggctaacaacggccgcggcagtgctggccgggggcgcctgtagggccgtgcccaccgccactcgcaagaggccctcaggggcagggggctgcggtgcccgcccccactccctcccaggcgcccggcggacttggctggagctgatgcctgcacgcgccttccaccggcctcgcaccagggtctcccttcccacatcaggccgctgcccagtggtgtccacaggcctgtcctgccgggctggcggcgacctctgtatggtcctcccacttgcttggaggaccctccgggatggggctttcgggccctgtgggccttggggccatggccaggataggaggtgctgccgggcctgctgtcctggtgaccctcttgcttcccaggcagtgacctgcagagctcccactgcacgctggacgaggccttcgaggacctggactgggacactgagaagggcctggaggctgtggcctgcgacaccgaaggcttcgtgccaccaaaggtcatggtgaggcccagcccgggcagtgctcctctacaccccgagcaggactccgccccaacccgagtccagccagctctgcctgggaccacgcagccttctccagctgcctgggggagggtgtctcacagggctatacccttgggctgcctggcagccagaaggtagcctcatgggggctcccacagccccttggcttttggatgggcctggggcccctgagcagctctttgtctccgcagctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 19590 - DNA, 3577 bp, Homo sapiens
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcggttgggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 19591 - DNA, 3577 bp, Homo sapiens
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 19592 - DNA, 1523 bp, Homo sapiens
gaatgcagctcgggaggagacttgatccagagcgccaggcactgcacctttgttctggagttgaaggggagccctggaaggctgtcgcgggaagagcactgggtgggatttgcctttgggtgggaggtggtgccaggagccagggagagcactggcttcccacaccgaaggggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcct

SEQ ID NO: 19593 - DNA, 2690 bp, Homo sapiens
tcccagctactctggaggctgagacgagaatcgcttgaacccgggaggccgaggttgcagtaagccgagatcgcgccactgcactccagcctgggcgacagagcgagactccgcctcaaaaaataaataaatgttgactggtttagctaattcaggtacagcaaatatttgttgagttcttttgtagggctgtgggaagatatgggaggcttttcattaacacaacactgattttacattctacttttcaaaaatacagttgtacaaagcatggtttaaggtggggtcccagacacctagaataaataagcttagaatatccaagaagtgccaggggcggtagttcacgcctgtaatcccagcactttgggaggccgaggcaggcggatcacctgaagtcaggaggagaccagcctggccaacatggagaaagcccgtctctactaaaaatacaaaaaatagactggcgtggtggcgcatgcctgtaatcccagctacccgggaggctgaggcaggagaatcgcttgacccgggaaggggaggttgcagtgagccgagatcgtgcctttgcaccccagcctgggcaataaaagtgagactgtcccaaaaacaaaacaaacaggctgggcatggtggctcacgcctgtaatcccagtagtttgggaggccgaggcaggcggattacctgaggtcaggagttcaagaccagcctggccaacatggtgaaacccgtctctactaaaaataaaaaattagccgggggtggtggcacacacctgtaatcccagctactcgggaggctgaggcgggacaactgcttgagccctggaggcggagattgcagtgagccgagatcgtgccactgcactctagcctggccgacagagcgactcaaaaaaaaaaaaaaaaaaatccaagaagtgcccaaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggagggcggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatg

SEQ ID NO: 19594 - DNA, 1059 bp, Homo sapiens
gcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 19595 - DNA, 6629 bp, Homo sapiens
ggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctataggtaagccagccagcagtatgacctcccctctgggtgttaactcctcggcctctgtaatcaagacagattcttatgcaggcccagactctgctggtccgcttctcaaaagttctctcattaccccaacagtggctgcatttcctttggaaagtgctgaccctgccggggtggctcccacaactgccaaaggtacctcaacttatacaactacagccagcccttttctagaaggaactgtctctttagctcctaaaaaccacccagttaaggaaggtactcttactactttacccttggttcctacagcttcagaaaattgccctgtggctccatccccccagaatacctgtgctcctctggctaccttagtgctggcccctgaaatcccaaagtctgtgccctcaccctctcttcccccagctgggactcctccaggtacaaaaaaggttgatggtatttctcatacttcagcattggcacctgttgcttcctctcccaaagagtgcccaactgaggactctggtgcttctgctactgcatcttccaaaggaactctgacttacctagctgattccccatctcctttaggggttagtgtgtctcctcagactaaaagacctccaaccaagaagggttctgctggccctgatactcctattggaaatctctcatcccctgtttctccagttgaagcttcatttcttccagagaatagtctttctttccaaggctctaaagactcaccagccacgacgcattctcccactcctccatcccccaaaggggcccctactccctcagctgtgactcctctgtctcccaaaggagtaacactaccccccaaagagacccccactccttcagtggtgaatctgcccttccccaaagagggtccagctactccagcacccaaacaggctcctgctctatccatgacttcttcctcccccaaaaaggcccgagcaactccagcccctaaaggaatcccagcttccccatcccccaaaggggcccccacacccccagctgcaactcctccctcccctaaaggaggcccagctaccccatccccgaaatgggcccccacacccccagctgcaactcctccctccccaaaaggaggtccagctactccatcccccaaaggggcccccacacccccagctgcaactcctccctcccccaaaggaggtccagctactccatcccccaaaggggcccccacacccccagctgtgactcctccctcccccaaaggaagtccagcagctaccccattccccaaaggggcatccacacccccagctgcaactcctccctcccccaaaggaagtccagcagctaccccactccccaaaggggcccccacaaccccagctgcaactcttccctccccaaaaggaggtccagctaccccatccctcaagggggcccccactcccccagctgcgactcctccctccccaaaaggaggcccagctaccccatcccccaaaggggcccccatgcccccagctgcaactcctccctccccaaaaggaggtctagctaccccaccccacaaaggggcacccacaaccccagctgcaactcctccctccccaaaaggaggtctagctaccccacccccaaaaggggcccccacaaccccagctgcaactcctccttccccaaaaggaggtctagctaccccacccccaaaaggggcccccacaaccccagctgcaactcctccttccccaaaaggaggtctagctaccccatcccccaaaggggcccccacaaccccagctgcaactcctccctccccaaaaggaggtctagctaccccatcccccaaaggggcccccacaaccccagctgcaactcctccctccccaaaaggaggtctggctaccccatcccccaaaggggcccccacaaccccagctgcaactcctccctccccaaaaggaggcccagctaccccaccccccaaaggggcccccactcccccagctgcaactcctccctccctaaaaggaggtctagctaccccaccccacaaaggggcccccaatcccgcagttgtaactcctccctctccaaaaggaggcccagctacctcaccccccaaaggggcccccactcctccagctgcaactcctccctccccaaaaggaagcccaggtaccccaccccccaaaggggcccccactcccccagctgtaactcctccctcccctaaagggacccctactctcccagctacaactccctcctctaaaggaggcccaactactccatcctccaaagagggccccactcccccagctgcaaccccctcccacaaaggaggtcccgctatgactcctccctcccccaaaagaggaccagctatcccatctcccaaaggggaccccacttccccagcagtgattcctctctcccccaaaaaggctccagcaactccagtcaccagagaaggcgcagccaccccatccaaaggagatctcactcccccagcagtgactcctgtctccctcaaaaaggccccagcaacttcagcccccaaaggaggcccagctaccccatcctccaaaggggatcccaccctcccagcagtgactcctccttcccccaaggagcccccagcccccaaacaagttgccacttcttcctctcccaaaaaggccccagcaactccagcccccatgggggcccccactctgccagctgtgattccttcttcccccaaagaggtcccagctaccccatcctccagaagggaccccattgccccaacagcgactcttctctctaaaaagaccccagcaactctagcccccaaagaggccctcattcccccagctatgactgttccctcccctaaaaagaccccagcaattccaacccccaaagaagccccagctaccccatcctccaaagaggcctccagtcccccagcagtgactccttccacttacaaaggggccccatcccccaaagagctcctcattccaccagctgtgacttctccttcccccaaagaggcacctactcctccagctgtgactcctccatcccccgaaaagggcccagcaactccagcccccaaagggactcccacttccccacctgtgactccttcctccctcaaagactcccctacttccccagcttctgtcacatgtaaaatgggggccactgttcctcaagcatctaaagggcttccagcaaagaaaggccccacagctctgaaagaagtacttgttgccccagctccagaaagcacgccaatcatcacagctcccactcggaaaggtccacagaccaaaaagagttctgctacttcacctcctatatgcccagatccctcagctaagaatggttctaaaggacccctttccacagtggctccagcccctctactccctgttcagaaagactcttcaaagacagcaaaaggcaaagatgcttctcattccccaaagggccccttggctcctcctgagtctaaggcgtccacccctctaacagcagctgcctttgagaaggtccttcctaaacctgaatcagcatctgtctctgcagcaccctccccaccagtctctctgcctcttgctccctccccagttcccactctgcctcctaaacagcaatttctgccgtcctctcctgggctggtgttggaatcaccctctaaaccccttgcccctgctgatgaggatgagctgctgcctctgattcccccggaaccaatctctgggggagtgcctttccagtcggtcctcgtcaacatgcccacccctaaatctgctggaatccctgtcccaaccccctctgccaagcaacctgttacgaagaacaacaaggggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattc

SEQ ID NO: 19596 - DNA, 802 bp, Homo sapiens
cccctccgctccaggcttccttctgcaacaggcgtgggtcacgctctcgctcggtctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaag

SEQ ID NO: 19597 - DNA, 299 bp, Homo sapiens
gtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacagcctcctttttattcccttccttcagaaatgcccggcgaagccac

SEQ ID NO: 19598 - DNA, 690 bp, Homo sapiens
gtgacaagcaagtgttggacttaaaacaccgtctttcccctcctggtaccccaaagtcggcaaacgtagtccaggaggccccagcccagccagtaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagcc

SEQ ID NO: 19599 - DNA, 711 bp, Homo sapiens
aactatatatgtgtcttaaacctcaaagtaaattttccttgagaaataatttatgttgaaaagatttcctggccaagtgcagtggctcacacccgtaatcccagcactttgggaggccgaggcaggcggatcacctgagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagcca

SEQ ID NO: 19600 - DNA, 1074 bp, Homo sapiens
actttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaagggcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 19601 - DNA, 2922 bp, Homo sapiens
ctttctgccgccatcttggttccgcgttccctgcacaaaatgcccggcgaagccacagaaaccgtccctgctacagagcaggagttgccgcagccccaggctgagacagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctatagtggctgcatttcctttggaaagtgctgaccctgccggggtggctcccacaactgccaaagcagctgcctttgagaaggtccttcctaaacctgaatcagcatctgtctctgcagcaccctccccaccagtctctctgcctcttgctccctccccagttcccactctgcctcctaaacagcaatttctgccgtcctctcctgggctggtgttggaatcaccctctaaaccccttgcccctgctgatgaggatgagctgctgcctctgattcccccggaaccaatctctgggggagtgcctttccagtcggtcctcgtcaacatgcccacccctaaatctgctggaatccctgtcccaaccccctctgccaagcaacctgttacgaagaacaacaaggggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatg

SEQ ID NO: 19602 - DNA, 728 bp, Homo sapiens
ggactgccaggggtgaaggcagccctgtctgaggccagaggtctgcccacgtggcggatgaggcaggtgtgaggccagcttgagcatctggatccatttgtctcgggctgctggctgcctgccatttcctcctctccacccttatttggaggccctgacagctgagccacaaacaaaccaggggagctgggcaccagccaagcgtcaccctctgtttccccgcacgggtaccagcgtcgaggagaaagaatcctgaggcacggcgaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctg

SEQ ID NO: 19603 - DNA, 855 bp, Homo sapiens
gagacagggacagacgtaggccaagagaggggaaccagagaggaaccagaggggagagacagagcagcaagcagtggattgctccttgacgacgccagcatgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaa

SEQ ID NO: 19604 - DNA, 1449 bp, Homo sapiens
ctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaaggtagagggagaagcctctgccctccccaccttttggggtcctagagggagttacccttctcaagcagccaatgccactcccatccctaaggctctcatctgactggggaaagggcatgtgccactccccagcccatcctcttttttccctccagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagaga

SEQ ID NO: 19605 - DNA, 4236 bp, Homo sapiens
ggttccctccggatagccggagacttgggccggccggacgccccttctggcacactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtga

SEQ ID NO: 19606 - DNA, 1699 bp, Homo sapiens
caggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcc

SEQ ID NO: 19607 - DNA, 3686 bp, Homo sapiens
tccccctgccaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcat

SEQ ID NO: 19608 - DNA, 7337 bp, Homo sapiens
acgcccaaataagaagccacctctaagcaaaatagtatatgtataaacggagggcgaatatatacaagtatatatatatgtatattacagacgcacaggtttacacccggtgaactttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaagcatgggtgaagtgtacaacaaaccaataatgataaaaaatacttctctttttctccctgtttccctttttcccttggccacagccaaatgctaattgctgctttaattacagagatgtgtaaatgtattcagattacaaactctacaggaatacatcaacattttaactcttttgcgtttttactgtttaactgttttaaatgcaagttattttagggtgacactccttccagttctggccagatcatgagtttcaagatcaagagtaaaaagttattagaattaaacagttttataaagggaggcagcccttttccctcaagaacaactttgttgagagttactacttgacagcaagcacagaaatgacaaatttaaaacttttacacatggcatttaccaaaattcccagtgattattttgtttaaaagagggaacctaaatatctactctattccctttcagttaactccacagaactttgtaggcatccatgaatacctgtaatagtgggttaggtgtggagataaggaatttggacaaagttgagtaagtttttactgggtatctgctttgcacccagtagtctgcaacatgagtttaaactcaggttactactttcacttatactttatggagaagatagacagtgagggaggaatgggaagctgtcatgagagtgcaccgtcttggaattacataactggggtctttcctcaataacattttgagcatctgaaaaatagtttaaaaaattgtcttaatatctattaaaaggcatgtctagtgaggaaacaggagagtctgagcaatcccttggtggcgatgaaggtggtagttcacacaagtaacagtggaggcaaaggtaagcgcaagctgcctgtcccagatgctggcccatgtgtgagtgcttccctggagaagtccgcttctgttgctcccacctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattccaaaaaggatggaagaagaaggcaagaagggcaaactccagaagttctagtgcaggaagagagtttgagaagtaaaatccaggcaagcaaagcgttgtaccacttgggactccccaaagtgaaacagcaaggaaggattgtgtccatcttacttacttgaattggagagcttgtttctctctcatttttatttttcaatgatgttttctttatattttagagatattcattttctcttatcttgtgcttgtaaaaagcatttacatttcaagtctatgtgcttattacaggggaaaaataatctacctggttgcagtctttgagtataaacatttctaacctttttaaaacttctatagcagcccattaacactaacatttttagagcaaatatattctattttaacttcaggtagaggaatagtcctaaacttaatatgatagctctagataagatcttagagataagtgagcatttagtattctaaaagtggcagaacaaatcatgaggtttctggatgctataccaatttaaaatcaattcttatgttaatattgattgcttatttacatgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaatgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttatgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatccc

SEQ ID NO: 19609 - DNA, 1753 bp, Homo sapiens
ggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaac

SEQ ID NO: 19610 - DNA, 1474 bp, Homo sapiens
aggtccgcgatggagccatctgcactgggaccttggtccttgttccctgaccttgcgccgagggaccaggaaggtcaggtgctcgccccgcgtcggtgcttcaggagggaatgtggccagaacgagaaagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctgga

SEQ ID NO: 19611 - DNA, 1153 bp, Homo sapiens
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 19612 - DNA, 1102 bp, Homo sapiens
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 19613 - DNA, 868 bp, Homo sapiens
tccccactgctcagcactaggccggcagaatctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 19614 - DNA, 832 bp, Homo sapiens
tccccactgctcagcactaggccggcagaatctgagcgatgtcttccacactccctgccctgctctgcgtcgaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 19615 - DNA, 1150 bp, Homo sapiens
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 19616 - DNA, 1154 bp, Homo sapiens
agcccaccagacccagactcacctacagctggagatccccacttccctgtgcccacagaatctgccctttgcagtctcccatctccccaacccaggcctcagcctgtctcatttttctatcagacgtgctggaagagcagcagaatcaggcccagctcccaattccctctccccagtcttctccaggtgtcccctcccatgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagacctcctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtgggttttaaggaatcggcacatgcagcatcaagggaggtctctgctgcacccagctcagcccaggccccaggcccatagacacttcccactgagccacagggcaccaggggggacatatggtggaaaaccatgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacact

SEQ ID NO: 19617 - DNA, 1000 bp, Homo sapiens
ccatgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagacctcctggactccccgcgacctggtctcttcacagacccagacccagagctgtgtgcctcccactgcaggagccagacaagcccctgagtctccatctaccatccctgtcccttcacacccgtcctctccccttcctgtccctctgccttccaggccacagaactccacgctccgccctggccctgcagcccccattgccctggtgcctgtgttctgtggactcctcgtagccaagagcctggtgctgtcagccctgctcgtctggtgggttttaaggaatcggcacatgcagcatcaagggaggtctctgctgcacccagctcagcccaggccccaggcccatagacacttcccactgagccacagggcaccaggggggacatatggtggaaaaccatgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtga

SEQ ID NO: 19618 - DNA, 942 bp, Homo sapiens
gagcagcagaatcaggcccagctcccaattccctctccccagtcttctccaggtgtcccctcccatgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagacctcctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtggggggacatatggtggaaaaccatgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttt

SEQ ID NO: 19619 - DNA, 1042 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 19620 - DNA, 541 bp, Homo sapiens
cccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagac

SEQ ID NO: 19621 - DNA, 875 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagaccccaataaatctgccccaccact

SEQ ID NO: 19622 - DNA, 1097 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatatgccaaatctactctctccggattcccccaactctgaactttcccttccaccaggtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 19623 - DNA, 875 bp, Homo sapiens; identical to SEQ ID NO: 19621

SEQ ID NO: 19624 - DNA, 1042 bp, Homo sapiens; identical to SEQ ID NO: 19619

SEQ ID NO: 19625 - DNA, 1097 bp, Homo sapiens; identical to SEQ ID NO: 19622

SEQ ID NO: 19626 - DNA, 541 bp, Homo sapiens; identical to SEQ ID NO: 19620

SEQ ID NO: 19627 - DNA, 875 bp, Homo sapiens
ccacaagctggccccttggcctcctagagaccctgacatctcctccagcagcatctgtcccctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagaccccaataaatctgccccaccact

SEQ ID NO: 19628 - DNA, 1042 bp, Homo sapiens; identical to SEQ ID NO: 19619

SEQ ID NO: 19629 - DNA, 874 bp, Homo sapiens
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagaccccaataaatctgccccaccac

SEQ ID NO: 19630 - DNA, 541 bp, Homo sapiens; identical to SEQ ID NO: 19620

SEQ ID NO: 19631 - DNA, 541 bp, Homo sapiens; identical to SEQ ID NO: 19620

SEQ ID NO: 19632 - DNA, 541 bp, Homo sapiens; identical to SEQ ID NO: 19620

SEQ ID NO: 19633 - DNA, 1042 bp, Homo sapiens; identical to SEQ ID NO: 19619

SEQ ID NO: 19634 - DNA, 1042 bp, Homo sapiens; identical to SEQ ID NO: 19619

SEQ ID NO: 19635 - DNA, 1097 bp, Homo sapiens; identical to SEQ ID NO: 19622

SEQ ID NO: 19636 - DNA, 1097 bp, Homo sapiens; identical to SEQ ID NO: 19622

SEQ ID NO: 19637 - DNA, 1042 bp, Homo sapiens
ccacaagctggccccttggcctcctagagaccctgacatctcctccagcagcatctgtcccctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 19638 - DNA, 1097 bp, Homo sapiens; identical to SEQ ID NO: 19622

SEQ ID NO: 19639 - DNA, 875 bp, Homo sapiens; identical to SEQ ID NO: 19621

SEQ ID NO: 19640 - DNA, 1042 bp, Homo sapiens; identical to SEQ ID NO: 19619

SEQ ID NO: 19641 - DNA, 541 bp, Homo sapiens; identical to SEQ ID NO: 19620

SEQ ID NO: 19642 - DNA, 1097 bp, Homo sapiens; identical to SEQ ID NO: 19622

SEQ ID NO: 19643 - DNA, 875 bp, Homo sapiens; identical to SEQ ID NO: 19621

SEQ ID NO: 19644 - DNA, 1097 bp, Homo sapiens; identical to SEQ ID NO: 19622

SEQ ID NO: 19645 - DNA, 1042 bp, Homo sapiens; identical to SEQ ID NO: 19619

SEQ ID NO: 19646 - DNA, 874 bp, Homo sapiens; identical to SEQ ID NO: 19629

SEQ ID NO: 19647 - DNA, 541 bp, Homo sapiens; identical to SEQ ID NO: 19620

SEQ ID NO: 19648 - DNA, 541 bp, Homo sapiens; identical to SEQ ID NO: 19620

SEQ ID NO: 19649 - DNA, 1097 bp, Homo sapiens
ccacaagctggccccttggcctcctagagaccctgacatctcctccagcagcatctgtcccctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatatgccaaatctactctctccggattcccccaactctgaactttcccttccaccaggtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 19650 - DNA, 875 bp, Homo sapiens; identical to SEQ ID NO: 19621

SEQ ID NO: 19651 - DNA, 7337 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 19652 - DNA, 560 bp, Homo sapiens
aggctggaggccagccaggtgaagagctcgcccgcatgcgtgcgcgctgcgtgggagccgcgaggcccggggcgggagggggcctcgtcttggcctcctgcgctgtcgcgacgggccggcgtgaggcaccgtggcgcggacttcgtctcagccccgccctcgcccctgccctcgcccccgccctcgcccctgccctgaccgcttttctccccctctctcccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagagaatgtggtcttttgcaaaatgaaaag

SEQ ID NO: 19653 - DNA, 2683 bp, Homo sapiens
gccgcggggatcgtcaggccggagccgcgcggccgagcgggcggcgggcggaggggagggcttggcggccgggaggctcgcggcgcccgggccggcagggtccgcccgggccggcagcgtccgcccggcggcgggaggagggagcggcgcagacaaagagcggcgcctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaagg

SEQ ID NO: 19654 - DNA, 790 bp, Homo sapiens
ggagcttttgtgcccggcttcaggctctgcgccctgccccagatttacaggactctaacagccacctgaatgaaccaaagtttctcacaatcgctcggctctctcggtttttttcagggcgatttaatcaccgagtgcttttggaaaaatttgatatatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgca

SEQ ID NO: 19655 - DNA, 2371 bp, Homo sapiens
tggagtgaagtggtcgtttattggctggccctctgatatgaggtggtggtgaattggtgggcgtcagtgcagtaagtgagcgagccggacgtcgattgactggtcttcagaagcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaa

SEQ ID NO: 19656 - DNA, 494 bp, Homo sapiens
tggtgtgacttagtttttgattgctggatttcactggagtgaagtggtcgtttattggctggccctctgatatgaggtggtggtgaattggtgggcgtcagtgcagtaagtgagcgagccggacgtcgattgactggtcttcagaagcaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacg

SEQ ID NO: 19657 - DNA, 1795 bp, Homo sapiens
ctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaagg

SEQ ID NO: 19658 - DNA, 490 bp, Homo sapiens
tcatcgttttgaagagttctgcgttttgccagtcacctctcaactgtgtgccaaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtga

SEQ ID NO: 19659 - DNA, 2989 bp, Homo sapiens
gcgcgcgcctgcgtagtgtgtcacggggcgggacaaccgcggcgcggctcggcgctcccggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 19660 - DNA, 2263 bp, Homo sapiens
ggcgggacaaccgcggcgcggctcggcgctcccggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagggaccgttcggggcgggccagaggccttggccaggagttcctcgcctgttagaaccaggatccaccccatcgcgggagccgcaccctgtggagcgttctggggtcccggccctgacctcttcctgggcttcgggatgcccgcgtcctctgcacccggcgctgcagctcgttatcgattccgcctttggaggccggtccgtatag

SEQ ID NO: 19661 - DNA, 2925 bp, Homo sapiens
gcggctcggcgctcccggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 19662 - DNA, 4989 bp, Homo sapiens
gcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgtccggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaagcaaggacaagtttggaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtcttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattga

SEQ ID NO: 19663 - DNA, 4585 bp, Homo sapiens
ggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtcttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattga

SEQ ID NO: 19664 - DNA, 8030 bp, Homo sapiens
aacagtaatgccatttttcctggccctgggattaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggacgaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttatagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggttctgtttgta

SEQ ID NO: 19665 - DNA, 769 bp, Homo sapiens
gtgatcgtgacctgtccattcccaccagtgcaggggtccatgagcccccaaaggtgcagtgagttgtaggcatttctgtgttttctttttctgaagaaagagtttgttggtttcatcagatcatcagaaggctgggtgtccctgtggagtgctgacggggccgtgtgcactgcgggcttgagaaatggtggcagcgtggtgcaaatagaaagtagcctggtggcagtgtagcatcctgggtcagggtgtggtcttggagacgggctgttggcttctgagctggcacctccacttaggagctgtgtgacattggccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctg

SEQ ID NO: 19666 - DNA, 576 bp, Homo sapiens
gttaaccctggcccgggccggagcccggaggcgcacgcacggcccgggggacccaggcgtcccgctcctcgccgggagcgccccttcccccgagccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgt

SEQ ID NO: 19667 - DNA, 777 bp, Homo sapiens
gggagaatccgggtggaagtcgagaaatccagccccgatagcagcgctcggtcccgccccggcccccgccccggggcgctcaccgcacgcccgccggccgccccggcctccggagctcttctctggccggcacccacgcggcatcacgggatcgaaccccgctcccagcggccgcgattcggggagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctg

SEQ ID NO: 19668 - DNA, 3789 bp, Homo sapiens
gctcggccggcagtgccatcgcgcggagaggagggggtgcgcttccgcgggcggggcgcggagcccgccgtctcggaggccgcggctcggcccggcactgcggagggccgcttgatttcccggaacccaggtcgcgcggctgctagggccggagccggtggatccgagcgggtgccaccagcggcggcgcgccgcctcccccggtgggagcggtggttgggccaggctgcggcagagcgttcgctcggagatggcggagcagccgcgacgcggcccgtggccccgaaagcagggaagccgggcagccccgggacgcggcggagcccggggacagcggggacgccgcccagtcctccgggtatgaagctaaaatgcagcggctaagaacgcggctctggagcttgacaggcctgacgtcgaatcccagccctcccaccaactgagctgtgtgatcctgggcaaggtagaggggaagagattgaactttgctgacctttgatgtgaggcgctcagccagggccaaggggagagcctggcaagatttgcagcctgaagccatgggccagggggccatggtgacctgagacaagtggactctgtatagttgccccctgcttccccttctacctcccctaccctatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccttcctccccccgccatgctccagttgtggaaggtggtacgcccagctcgacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaaggggcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttc

SEQ ID NO: 19669 - DNA, 3749 bp, Homo sapiens
gagatggcggagcagccgcgacgcggcccgtggccccgaaagcagggaagccgggcagccccgggacgcggcggagcccggggacagcggggacgccgcccagtcctccgggtatgaagctaaaatgcagcggctaagaacgcggctctggagcttgacaggcctgacgtcgaatcccagccctcccaccaactgagctgtgtgatcctgggcaaggtagaggggaagagattgaactttgctgacctttgatgtgaggcgctcagccagggccaaggggagagcctggcaagatttgcagcctgaagccatgggccagggggccatggtgacctgagacaagtggactctgtatagttgccccctgcttccccttctacctcccctaccctatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaaggggcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 19670 - DNA, 447 bp, Homo sapiens
ggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgaggtaagtaaagccaggggcaggggaatccctctccacttccaggatctgattctgtgtcccacttcttaccatttctgc

SEQ ID NO: 19671 - DNA, 1599 bp, Homo sapiens
aagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaagtaaggctttagtgatgattccacaatgactttattcagatattttgtttctaacagcacaggagaatattgcattttagataatatctttaattgcaagaataaacagagataatgtttctgaacccagttcagatgggcttgcaatcattatgaatttcagtaaaggaaaaaaattaagtctaattttaagcataaaacaaagttttcttttctccaggcataaatctgaacatttttcaatgtctctagccatgttgtcacatttccctggatttccagaagtcattaatagtcatactaaataattgtgttttaacctacacacacacacacacacacacacacacacagtttttaacttagtaataaaaatattaattttcccaattttcaagtgcttttgtttaatcacaaaatttaaaaagggagatgaaaatgaagaaaactttgaagtcttatcaaagagcataaaataagatctgaaaaagtataaaggcattttatgtttttggctgaaagtttcaatagataaagatgtcagttctttcagaattatataaacgtcatgcaacttctgttagactccaacagcgtttttttttttttttaatatagataaaatgatcttaaagtttgtgtggaaagaaaataccagggaatagcctttaaaagtatgaaaatgaagaccagtgaaggggaacttaagttatgagttactataagttaatagaaaaccactgaaattaaatcaatatgggattggtgtagtgagagattaaataatcagtaggatagaatagggagtcctgaaatagattccagtatgtataagaatttaatatatgataaaagtgtcgattcaagtcagtgggaagaagttggattagctaataaatggtgct

SEQ ID NO: 19672 - DNA, 9216 bp, Homo sapiens
cttgagtgttagagctgagtagttttcccagaatctctaagtcctttttatgctcttttatgaatgaatagaattagtaaaagataaataaattttttcttttggatttcttaaccagtggaaaaaatgttgactttaaaagttcataaaatcaaattttgcttaagaatatgttatttccacttgtgaggccagcctggtagacctctgggatccttttctgttcactcacacaccactgagataaggagtgaagtgtgggctaaatagggctgaggcttgggcaagggcatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacacctggtgctgctaattgtgttcatggtttcctttgattggctattgaacccttctgggaaatgtatttttgtagactttaatagagaagttgattgtcccttaaatgtagtgtgtgtttgaaacttcttagctgtcactttggaatcaccccaagccaattctcttaactctgtaatgcagccaataatttcaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagttttgaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtatcttcttttggaaaatggtattcaaattctggaatggaaatctagccaccaaaacgggttaatcaaaagacgtccttttccatttttttttgcttttattttctaaatcatttttaagggaatgaaacaggaatgtcatcagagattttttagtacaggcccaagagcctgttctctaagaaagaaattgttgccatgttttgattttcgaataagtgactttgcaggctttatgctagcccttgctggtgggtcttgaaatttcatccagagtctgcagtccaggtcaccaagccagcggcacccgtcggcaaccctgtgtttttctgattgtgccgtttactgtgacctgcaacggggtggcattcacttagggtctgacttcacagctatgacaaaaccgaaaaagcaaaactgcaaaaaagtactaagatgtacgggtcttggggatatctgccttatatgttatattcaaggaaattaacaaaacatcctgtaaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcacttcttggctctcaccgtggtttcttggagcatgggttgttagatgcaagcaatgcaccctaataataccccgggtctgagatttaacatgacaactcacatcaaatcgcatcagaggtgtgtgctgccttcagtgcatttacattggtgaatcagtcaagatattttcctcccccaaataaacttagttgtaagtgataacaatattatgcttctccaagctcagtatctttctgattttatatcaaagtaccgcaacaatgcatcattgtagttaatttatttcaagaataaattcctcatatgtcctcaatagtacaattctaattttcttctattcataagatgaaagaaatggtttggagcatagaatagaaagtgcacaaattgagtacataaaatgggaagcaactgatttctcagctaagaaaggctcatttatcacagaacacaattgcttttctccccccactacgcttcccataattgaaaaagtgagtccctatttttcacactcatataaatctatgcgatttggatgctagtcttattgtattattttgtaaaactttctctttggctcataatccttcctaattgtaaattgataaactttgcggatgacatctgctcgtagaataaacacttcttccaaa

SEQ ID NO: 19673 - DNA, 989 bp, Homo sapiens
agatgcttcatttctattatgagtggctgcattctggctccaggggcgcagtccctaagccgctacactacccgaagcagtccttcaccacggtggcagatacacctgaaaatcttcgcctgaagcagcaaagtgaattgcagagtcaggtcaagtacaaaagagattttgaagaaagcaaagggaggggcttcagcatcgtcacggacactcctgagctacagagactgaagaggactcaggagcaaatcagtaatgtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacacctggtgctgctaattgtgttcatggtttcctttgattggctattgaacccttct

SEQ ID NO: 19674 - DNA, 3008 bp, Homo sapiens
cctgcgcggcggcggcggcgaggcgggggagcgagtgagcgcgaggggcgggcgcgagtgactgtgtgagtcacccgtacctggagtgcgagcgacgcagagccagcggcgcggagccggagccggagccgagacccagcgcctgcgagcccgagagcgcggccggccccaggcgccaggccccgtcgccctccccgtgcactcacccgtggcccggcgccgactccctacccggcgcccgccgcccgcagccctcccgcctgccaggaggcggtgcggggctcgccgggggatgtcacagcggctcctgggagccagcagccgccgccgccgccgcccccgggaaccgcgatcatgaacccccagtgcgcccgttgcggaaaagtcgtgtatcccaccgagaaagtcaactgcctggataagtattggcataaaggatgtttccattgtgaggtctgcaagatggcactcaacatgaacaactacaaaggctatgaaaagaagccctattgtaatgcacactacccgaagcagtccttcaccacggtggcagatacacctgaaaatcttcgcctgaagcagcaaagtgaattgcagagtcaggtcaagtacaaaagagattttgaagaaagcaaagggaggggcttcagcatcgtcacggacactcctgagctacagagactgaagaggactcaggagcaaatcagtaatgtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacacctggtgctgctaattgtgttcatggtttcctttgattggctattgaacccttctgggaaatgtatttttgtagactttaatagagaagttgattgtcccttaaatgtagtgtgtgtttgaaacttcttagctgtcactttggaatcaccccaagccaattctcttaactctgtaatgcagccaataatttcaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagttttgaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtatcttcttttggaaaatggtattcaaattctggaatggaaatctagccaccaaaacgggttaatcaaaagacgtccttttccatttttttttgcttttattttctaaatcatttttaagggaatgaaacaggaatgtcatcagagattttttagtacaggcccaagagcctgttctctaagaaagaaattgttgccatgttttgattttcgaataagtgactttgcaggctttatgctagcccttgctggtgggtcttgaaatttcatccagagtctgcagtccaggtcaccaagccagcggcacccgtcggcaaccctgtgtttttctgattgtgccgtttactgtgacctgcaacggggtggcattcacttagggtctgacttcacagctatgacaaaaccgaaaaagcaaaactgcaaaaaagtactaagatgtacgggtcttggggatatctgccttatatgttatattcaaggaaattaacaaaacatcctgtaaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcagg

SEQ ID NO: 19675 - DNA, 633 bp, Homo sapiens
gttctgatcctagtgcttcattgaatggctttgtaaatgagacacataatttttcatagccttcattttgtcatctgtgaaagagagggctttaggtgtattgatttcttaaggatccctttggcttgaaattctgattctagaatctcaaatggaaaatttgtgttcacattgcacgtggtgtttggtttttgttttcaaaagtttgtgcattaaatctcaacagcttattttcttgcagcacagtgaagagtccctaagaacatattacgtgatgggaaatgagaaataactgcactgcaagcctgatgaaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgcca

SEQ ID NO: 19676 - DNA, 20577 bp, Homo sapiens
tttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgc

SEQ ID NO: 19677 - DNA, 2057 bp, Homo sapiens
gaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgc

SEQ ID NO: 19678 - DNA, 25458 bp, Homo sapiens
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggtgttatacaaagaaaacatgggcaagggaacccctctacctgtcactcctgagatggagagagtcaaacacaatcaagaaaatattagctcggttttgtacaaagaaaatgtggggaaagccaccgcaacccctgtcactcctgagatgcagagagtcaaacgcaatcaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 19679 - DNA, 26202 bp, Homo sapiens
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgttgtataaagaaaacgttggaaaagggattccaatccccatcactccagagatggagagagtcaaacacaatcaagaaaactttagttcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 19680 - DNA, 20637 bp, Homo sapiens
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaactc

SEQ ID NO: 19681 - DNA, 26202 bp, Homo sapiens
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgttgtataaagaaaacgttggaaaagggattccaatccccatcactccagagatggagagagtcaaacacaatcaagaaaactttagttcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 19682 - DNA, 1051 bp, Homo sapiens
gcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaagagaaaaaaagaaaaaaaaaaagaaagaaagtg

SEQ ID NO: 19683 - DNA, 1557 bp, Homo sapiens
aagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagta

SEQ ID NO: 19684 - DNA, 1012 bp, Homo sapiens
gcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagttaaagtgcagcaaaga

SEQ ID NO: 19685 - DNA, 5507 bp, Homo sapiens
aaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatgg

SEQ ID NO: 19686 - DNA, 5402 bp, Homo sapiens
aaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgagaataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatgg

SEQ ID NO: 19687 - DNA, 2714 bp, Homo sapiens
atcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatgtacaccttcttctttctctcaagattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatgggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagtttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagc

SEQ ID NO: 19688 - DNA, 5629 bp, Homo sapiens
tcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatgtacaccttcttctttctctcaagattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgct

SEQ ID NO: 19689 - DNA, 5535 bp, Homo sapiens
aaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgagaataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatgtacaccttcttctttctctcaagattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgct

SEQ ID NO: 19690 - DNA, 2587 bp, Homo sapiens
gcgctttgcatctccgcctcccgtgctccgcctccggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgttaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 19691 - DNA, 1015 bp, Homo sapiens
aagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactggtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgca

SEQ ID NO: 19692 - DNA, 2545 bp, Homo sapiens
aaaaaaaaaaaaaaaaaaaaaaaaaaaaaaaaaaaaaaaaaaaaaaaaaaaaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgttaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaatt

SEQ ID NO: 19693 - DNA, 1634 bp, Homo sapiens
aagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcagtcggactcgggaacatcaataggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgtttatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttca

SEQ ID NO: 19694 - DNA, 2070 bp, Homo sapiens
gaaacctggtcagagagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgtttatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtca

SEQ ID NO: 19695 - DNA, 1291 bp, Homo sapiens
ggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 19696 - DNA, 1929 bp, Homo sapiens
aagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcagatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgtttatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 19697 - DNA, 935 bp, Homo sapiens
ggaagtcgccggaagttcggtgggctccaggcgtcgcgatggaggagagcggggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactg

SEQ ID NO: 19698 - DNA, 1787 bp, Homo sapiens
gtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgtttatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 19699 - DNA, 1886 bp, Homo sapiens
acttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatggg

SEQ ID NO: 19700 - DNA, 1681 bp, Homo sapiens
agcacgcagtctcagccgacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagcacttaa

SEQ ID NO: 19701 - DNA, 3851 bp, Homo sapiens
gggcacgtaggtgaagctcagtgcttggcacgaggtgctcatcagcagcatcgcccttgctttgggctggcctgttagtaattcgtttttagtggaatcgaatacaacacttgagcctcggaggctcaggtcgtcggagcaactacaccagggccggtgcacctcggggcggcggcgcaggactaggctaggccgggccgggccgggcagggcggcgcgagtcgggggtggggcggcggcgcagcgccgtcgtcgtagtccccgcctcttccccaggggccgcgtcggagcctcggcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaatgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 19702 - DNA, 625 bp, Homo sapiens
gtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattag

SEQ ID NO: 19703 - DNA, 4625 bp, Homo sapiens
cttacttttccatctcctcccacccagctataccctcccactggcggcgcggatggcacgccggcggagccagcgagtctgcgcgagcggtccgagcatgctcaatagcgcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttattttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtggaagtgtgaacctgtgatgcatccttttcaaaatcagtttaagattcgcatattatcatgactgtgacctcactaaactgtttatgtgacaaacctttcaagattggagatgaaaacaacacttgtgaaattaggttggggttgcaacatcttttaacttctcagttatttgtatgtcaggagacagattgtggtttaattttaataaacaaaatatcatctttttgaaaat

SEQ ID NO: 19704 - DNA, 1837 bp, Homo sapiens
ggtagcggcgaaggggcgctcagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataa

SEQ ID NO: 19705 - DNA, 1909 bp, Homo sapiens
agtgcgcctgcgcgcttgtggagctggtggcggcgctccgcaggggctcggctgttttccgcgcggcaggcgcggccatggcgcagctgggaaagctgctcaaggagcagaagtacgaccggcagctgaggcgattcctccatacatttgacagctgtctgggcccttatggagcatacagtggagtggaaagatggatgctcagcaaacaaaaacaaatgaagccaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgt

SEQ ID NO: 19706 - DNA, 1707 bp, Homo sapiens
agtgcgcctgcgcgcttgtggagctggtggcggcgctccgcaggggctcggctgttttccgcgcggcaggcgcggccatggcgcagctgggaaagctgctcaaggagcagaagtacgaccggcagctgaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgt

SEQ ID NO: 19707 - DNA, 4597 bp, Homo sapiens
ggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcct

SEQ ID NO: 19708 - DNA, 2897 bp, Homo sapiens
ggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtaaaaatagttcttttaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagggtctctggggcttgctgtcattccttcatctggccaaaaaatgcttcttcctgaaagccccgagtgaagcattctcctggttctaa

SEQ ID NO: 19709 - DNA, 4597 bp, Homo sapiens
ggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtaaaaatagttcttttaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcct

SEQ ID NO: 19710 - DNA, 4973 bp, Homo sapiens
ccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcct

SEQ ID NO: 19711 - DNA, 1318 bp, Homo sapiens
acagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatga

SEQ ID NO: 19712 - DNA, 2703 bp, Homo sapiens
atccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagccaataatttctgaagatcagacagcagccctgatggcccatctctttgaaatgggattctgtgacaggcagctgaacctacggctgctgaag

SEQ ID NO: 19713 - DNA, 2712 bp, Homo sapiens
agcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctc

SEQ ID NO: 19714 - DNA, 3022 bp, Homo sapiens
tatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttt

SEQ ID NO: 19715 - DNA, 2400 bp, Homo sapiens
tccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgacca

SEQ ID NO: 19716 - DNA, 2943 bp, Homo sapiens
agaaggatccatctaacatttactgaaataaggaagatgctttattcaatctaaaagtgaaaaaagaaccttttagacattattattataaaatgtctataagaagacttctcattttaatcctcaaaatagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcag

SEQ ID NO: 19717 - DNA, 3203 bp, Homo sapiens
gtgcttgccttggagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataacac

SEQ ID NO: 19718 - DNA, 3612 bp, Homo sapiens
ggcccgcccctccctccccggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataa

SEQ ID NO: 19719 - DNA, 3279 bp, Homo sapiens
gctcagttccccttgccttctgctgtatgctggtcccagagagcccgagtccgggtctccacgctttatttggcagggggcgcgcgggttccggagctgtccagcacctcctggccaagttctctgcgctctccgcgcccgggaagctctccgcgccggggaagctctccagcgccccgcccccggcagggaacctctccaccaggacacccggggcttcccaggctcgccatccgtccccaccagtctctacctactttgcccagctccacctcggcagtgcagcgtgttttggtggccttcctccgcacgccctggagggggagtgccctgcaccccggggctgctccggagcccagtgcacgagtgcacatgggcttccctcctttgcttaaagggcaggcgagcgctactcgctccagccttgcctcctgcagctgggtggtcttttttctctcctgtctttcaagacacgcgcccgaaatcgagggagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtg

SEQ ID NO: 19720 - DNA, 3196 bp, Homo sapiens
ggaggagcagtctctccgcgcgtctcccggagctttctccattgtctctgcctttacaacagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 19721 - DNA, 2321 bp, Homo sapiens
attgtctctgcctttacaacagagggagacgatggactgagctgatccgcaccatggagtctcgggtcttactgagaacattctgtttgatcttcggtctcggagcagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcatttgcctggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacct

SEQ ID NO: 19722 - DNA, 586 bp, Homo sapiens
gagtggccgcagagctggggctggggaaagggatggctcccgcctcggggcagcatgggctggctggggaagcctcgcttttcccggacccaaagtaggtctggagtgggaagcttggagtaagggggcgggtttggatatggattttttttttttctgtgcttgccttggagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacag

SEQ ID NO: 19723 - DNA, 3036 bp, Homo sapiens
attgtctctgcctttacaacagagggagacgatggactgagctgatccgcaccatggagtctcgggtcttactgagaacattctgtttgatcttcggtctcggagcagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtca

SEQ ID NO: 19724 - DNA, 500 bp, Homo sapiens
acttctttggatgctattttgaggatagactgaagggaatgatgatagcagggagaccagttaggatgatgacttagaccatggcagttgtgggtggagatggtaactgccagattctgtctatatattgagaagtagcaggcaggatgtactgagcaattggatgtgggatgtgagagaaatgactccaaggtttttggcctgagcaatcagaaggatccatctaacatttactgaaataaggaagatgctttattcaatctaaaagtgaaaaaagaaccttttagacattattattataaaatgtctataagaagacttctcattttaatcctcaaaatcactctggttatggattcctataagtgtatcctgttgaagtttgctgagctccttgaatctagggagacgatggactgagctgatccgcaccatggagtctcgggtcttactgagaacattctgtttgatcttcggtctcggagcagtttgggggcttg

SEQ ID NO: 19725 - DNA, 1053 bp, Homo sapiens
aaaccacatgtgaactgaagctgtcaggttccacaaaggcagaagtactctctgaaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtat

SEQ ID NO: 19726 - DNA, 7088 bp, Homo sapiens
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 19727 - DNA, 7342 bp, Homo sapiens
ggtcagcggctgcgcggccggccccctcccacgggagccgcgccagggcccagcaagagtcgggcgggatcgctattgtttttggcgagcacataaatccccgggccgacccactgcgcacccaggtttcctcccggaggcctttcggtttcctctgaggccctatatagaggctccaggcccggactgtgcagaggtgcgcgcccacgccggcctcccggaccagcctgagctcggagcgcctctcgccctcaggagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaa

SEQ ID NO: 19728 - DNA, 7067 bp, Homo sapiens
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgatgttgccatcccaacattacctcccacttcactgaccagtgccactactgaccatctagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 19729 - DNA, 4441 bp, Homo sapiens
gggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgact

SEQ ID NO: 19730 - DNA, 4315 bp, Homo sapiens
gggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgact

SEQ ID NO: 19731 - DNA, 2522 bp, Homo sapiens
acagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgc

SEQ ID NO: 19732 - DNA, 3756 bp, Homo sapiens
gatggcgtcaccttctggcgccgccggttggtttccctggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaacagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaggtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggcgtggtagtgcgtgcctgtaatcccagctacttgggaggctgaggtagaagaattgtttgaacctgggaggtggaggttgcagtgagccaagatcgtgccattgcactccagcctaggcaacaagagtgaaactccatctcaaaaaaaaaaaaaaaaaa

SEQ ID NO: 19733 - DNA, 1932 bp, Homo sapiens
ggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaa

SEQ ID NO: 19734 - DNA, 2752 bp, Homo sapiens
ggggctgggaggcgggcgcacatcgatggcgtcaccttctggcgccgccggttggtttccctggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaa

SEQ ID NO: 19735 - DNA, 2513 bp, Homo sapiens
aatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagagcagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaa

SEQ ID NO: 19736 - DNA, 5287 bp, Homo sapiens
tctgccccaccccgtcccgttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagcaagttgaaaaacacatgaaatggctgatagatccactgccagtgaatgtaagagtaattgtttctgtgaatgtagaaacatgccctccagcatggaggttgtggcctacacttcatcttgatcccttaagtccaaaagatgcaaaatctattataattgcagaatgccactctgtagacattaaattgagtaaagagcagtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtctttgttcaacaagagctggcagagtagttaagacaaggagttcaaaaattccatgaatcttggccaggcatggtggctcatgcctgtaatcccaccactttgggagggtgatgcaggaggatcacttgaggccaggagttggagaccagcctggccaacatggtgaaaccctgtctctactaaaaatacaaaaaaaaattagctggacctggtggcgcatgcctgtaatcctagctactcaggaggctgaggcatgagaatcgcttgaactcagcaagtggaggttgctatgagctgagattgtgccagttcattccaccctgggcaacagggtgagactctgtctcaaaaaaaaaaaaaaaaaaaaaaagaattccatgattcttttgagctctcaagagctactttagccttgccattcctcttgcttttcagcagtagtctggcccaattctctacctcaaaggaaagtttcaaggattaaagggttaatgtttatgaacgattcaaattgtcttcagtgaaacacattagtcacaagaatccctgattgctgcactttaaaaaattctttaccttttccttgagcagattggtccagtccctctgctttctgttctgtctacattgtgtattatttattactatatagtatatgtatctgcataatgtctgaagtcattaatgcagtaacaggtcaagctctttagcattctttgacttttcccaaaatatagatatgacattctcctttatcttccttcttagatggcctaaatctgtctcttcatttacctcaaactcaaattagtatgccattttcatactgaaaattaaatatttttatggattttataaatattgcaacattttagatattgttttggaccatttgtgtatttatatataataaaatcatcaatttaatacttgtaagatcctaacatgtattgattgtaaaagtgaaatatgtaatagccacacttcactgttttaaaataaaagtgcaatttcaagtt

SEQ ID NO: 19737 - DNA, 4362 bp, Homo sapiens
gttccgttcctctgccccaccccgtcccgttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagcaagttgaaaaacacatgaaatggctgatagatccactgccagtgaatgtaagagtaattgtttctgtgaatgtagaaacatgccctccagcatggaggttgtggcctacacttcatcttgatcccttaagtccaaaagatgcaaaatctattataattgcagaatgccactctgtagacattaaattgagtaaagagcaggagaagaagctagaacgacactgtcgttctgctacaacctgcaatgccctttatgtcacccttttcggcaaaatgatcgcgcgtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtct

SEQ ID NO: 19738 - DNA, 797 bp, Homo sapiens
tctgccccaccccgtcccgttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgtatcattggaatctgaccaacatcctggaatttttattgctaacttttaa

SEQ ID NO: 19739 - DNA, 486 bp, Homo sapiens
ggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcagggtctcgctgcggtggcacgatcgcggctcactgcaacctggaactcctgggctcaatga

SEQ ID NO: 19740 - DNA, 2186 bp, Homo sapiens
ataatagcaaatgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggta

SEQ ID NO: 19741 - DNA, 4124 bp, Homo sapiens
tctgccccaccccgtcccgttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagcaagttgaaaaacacatgaaatggctgatagatccactgccagtgaatgtaagagtaattgtttctgtgaatgtagaaacatgccctccagcatggaggttgtggcctacacttcatcttgatcccttaagtccaaaagatgcaaaatctattataattgcagaatgccactctgtagacattaaattgagtaaagagcaggagaagaagctagaacgacactgtcgttctgctacaacctgcaatgccctttatgtcacccttttcggcaaaatgatcgcgcgtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaagagcaggaaagtccaatccaaccttttatctccagaagggctttcaaacatatgtgctc

SEQ ID NO: 19742 - DNA, 4994 bp, Homo sapiens
gacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggatgaacgactggcacaggatcttcacccaaaacgtgcttgtccctccccacccacagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcacaggagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaactttt

SEQ ID NO: 19743 - DNA, 1705 bp, Homo sapiens
gcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcacaggagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaaggagacttctcatatcttctcagtctcccagtga

SEQ ID NO: 19744 - DNA, 4895 bp, Homo sapiens
aggggaagaggaaaacgagaaagggaggagagtaacggaaagagataaaaaagaaaagcaggtggcagagacacacagagagggacccagagaaagccagacagacgcaggtggctggcagcgggcgctgtgggggtcacagtagggggacctgtgatggccctggggacgacgctcagggcttctctcctgctcctggggctgctgactgaaggcctggcgcagttggcgattcctgcctccgttccccggggcttctgggccctgcctgaaaacctgacggtggtggagggggcctcagtggagctgcgttgtggggtcagcacccctggcagtgcggtgcaatgggccaaagatgggctgctcctgggccccgaccccaggatcccaggcttcccgaggtaccgcctggaaggggaccctgctagaggtgaattccacctgcacatcgaggcctgtgacctcagcgatgacgcggagtatgagtgccaggtcggccgctctgagatggggcccgagctcgtgtctcccagagtgatcctctccatcctggttcctcccaagctgctcctgctgaccccagaggcaggcaccatggtcacctgggtagctgggcaggagtacgtggtcaactgtgtgtctggggacgcgaagccagcacctgacatcaccattctcctgagtggacagacaatatctgacatctctgcaaacgtgaacgagggctcccagcagaaactcttcactgtggaggccacagccagggtgacaccccggagctcagataataggcagttgctggtctgtgaggcgtctagcccagcactggaggcccccatcaaggcctcattcaccgtgaatgttctgttccctccaggaccccctgtcatcgagtggccaggcctggatgaggggcacgtgcgggcaggacagagcttggagctgccgtgcgtggcccgagggggtaatcccttagccacactgcagtggctgaagaatggccagccggtgtccacagcgtggggcacagagcacacccaggcggtggcccgcagtgtgctggtgatgaccgtgaggccagaagaccatggagcgcagctcagctgcgaggcccacaacagcgtgtctgcagggacccaggagcacggcatcacactgcaggtcacctttccccctagtgccattattatcttgggatctgcatcccagactgagaacaagaacgtgacactctcctgtgtcagcaagtccagtcgcccgcgggttctgctacgatggtggctgggctggcggcagctgctgcccatggaggagacagtcatggatggactgcatggcggtcacatctccatgtccaacctgacattcctggcgcggcgggaggacaacggtctgaccctcacatgtgaggccttcagtgaagccttcaccaaggagaccttcaagaagtcgctcatcctgaacgtaaaatatcccgcccagaaactgtggattgagggtcccccagagggccagaagctccgggctgggacccgggtgaggctggtgtgtttggctatcgggggcaacccagagccctccctcatgtggtacaaggactcgcgcaccgtgaccgagtcgcggctgccgcaggagtcgcggcgcgtgcatctcggcagcgtggagaaatctgggagcaccttctcccgagagctggtgctggtcacagggccgtcggacaaccaggccaagttcacgtgcaaggctggacagctcagcgcgtccacgcagctggcggtgcagtttcccccaactaacgtgacgatcctggccaacgcatccgcactgcgcccgggagacgccttaaacttgacatgcgtcagcgtcagcagcaatccgccggtcaacttgtcctgggacaaggaaggggagaggctggagggcgtggccgccccaccccggagagccccattcaaaggctccgccgccgccaggagcgtccttctgcaagtgtcatcccgcgatcatggccagcgcgtgacctgccgcgcccacagcgccgagctccgcgaaaccgtgagctccttctatcgcctcaacgtactgtaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactatgctcccaccatccgtgccctccaggaccccactgaggtgaacgtcgggggttctgtggacatagtctgcactgtcgatgccaatcccatcctcccgggcatgttcaactgggagagactgggagaagatgaggaggaccagagcctggatgacatggagaagatatccaggggaccaacggggcgcctgcggattcaccatgccaaactggcccaggctggcgcttaccagtgcattgtggacaatggggtggcgcctccagcacgacggctgctccgtcttgttgtcagatttgccccccaggtggagcaccccactcccctaactaaggtggctgcagctggagacagcaccagttctgccaccctccactgccgtgcccgaggtgtccccaacatcgttttcacttggacaaaaaacggggtccctctggatctccaagatcccaggtacacggagcacacataccaccagggtggtgtccacagcagcctcctgaccattgccaacgtgtctgccgcccaggattacgccctcttcacatgtacagccaccaacgcccttggctcggaccaaaccaacattcaacttgtcagcatcagccgccctgaccctccatcaggattaaaggttgtgagtctgaccccacactccgtggggctggagtggaagcctggctttgatgggggcctgccacagaggttctgcatcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtctccaccagccttctggagaacctgaagaccagctgcccacagagccaccttcaggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagcctggggacccctctacgatgaagtgcagatgggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatggagggggctgagtgacagagatggttcagctggtaccagagtagaaacaaggtgcatcctggggttggctttagaaactaaacttctccaaaaggacagggcagattgtaaacgtcgtctcaaaaatgaaatgctgccgggtgcggtgactcacgcctataatcccagcactttgggaggctgaggcgggtggatcacctgaggtcaggagttcgagaccagcctggccaacatggtaaaactccatttctactaaaaatataaaaaattagccaggagtagtggcgcatgcctgtagtcccagctacttgggaggctgatgcatgagaattgcttgaacccaggaggcggaggttgcagtgagctgagatcacgccactgcactccagcctgggcgacagagcgagattctgtctcaaaaaataaaaataaaataaaaataaaaaataaaatgctattctgagggtccctaagtgcttcatgaagtaaagttttcagaagtggggaaagacatatgaaaaactctgttcattttgcattccatgacgtctgaaatagctaataataagtggaatttatgaatccatgttgcatcctacctattattttattatttccgacagttatctaacacaggaggcataaactatgacacatgtaaacataagtatgctccataagcattaaaataaacagacaatcaaaagaagctagaggaaaagaatatgtactgtgtgtgtgctttcgtttatagaaattctaaaataggcaaaactaatctacggtggcagagagcacagcagaggtttcctggggccatgagaggagggttgactgcaaaaaggcatgggagaactttctgaggtgttggaaatattctatataacgattgtggtggtggttgcacgggtgcacagatttgtcaaaactcattgaactttacacttaagatgggtgcatttttattgtacataaatgatatctcaataaaagtgatttt

SEQ ID NO: 19745 - DNA, 5015 bp, Homo sapiens
aggggaagaggaaaacgagaaagggaggagagtaacggaaagagataaaaaagaaaagcaggtggcagagacacacagagagggacccagagaaagccagacagacgcaggtggctggcagcgggcgctgtgggggtcacagtagggggacctgtgatggccctggggacgacgctcagggcttctctcctgctcctggggctgctgactgaaggcctggcgcagttggcgattcctgcctccgttccccggggcttctgggccctgcctgaaaacctgacggtggtggagggggcctcagtggagctgcgttgtggggtcagcacccctggcagtgcggtgcaatgggccaaagatgggctgctcctgggccccgaccccaggatcccaggcttcccgaggtaccgcctggaaggggaccctgctagaggtgaattccacctgcacatcgaggcctgtgacctcagcgatgacgcggagtatgagtgccaggtcggccgctctgagatggggcccgagctcgtgtctcccagagtgatcctctccatcctggttcctcccaagctgctcctgctgaccccagaggcaggcaccatggtcacctgggtagctgggcaggagtacgtggtcaactgtgtgtctggggacgcgaagccagcacctgacatcaccattctcctgagtggacagacaatatctgacatctctgcaaacgtgaacgagggctcccagcagaaactcttcactgtggaggccacagccagggtgacaccccggagctcagataataggcagttgctggtctgtgaggcgtctagcccagcactggaggcccccatcaaggcctcattcaccgtgaatgttctgttccctccaggaccccctgtcatcgagtggccaggcctggatgaggggcacgtgcgggcaggacagagcttggagctgccgtgcgtggcccgagggggtaatcccttagccacactgcagtggctgaagaatggccagccggtgtccacagcgtggggcacagagcacacccaggcggtggcccgcagtgtgctggtgatgaccgtgaggccagaagaccatggagcgcagctcagctgcgaggcccacaacagcgtgtctgcagggacccaggagcacggcatcacactgcaggtcacctttccccctagtgccattattatcttgggatctgcatcccagactgagaacaagaacgtgacactctcctgtgtcagcaagtccagtcgcccgcgggttctgctacgatggtggctgggctggcggcagctgctgcccatggaggagacagtcatggatggactgcatggcggtcacatctccatgtccaacctgacattcctggcgcggcgggaggacaacggtctgaccctcacatgtgaggccttcagtgaagccttcaccaaggagaccttcaagaagtcgctcatcctgaacgtaaaatatcccgcccagaaactgtggattgagggtcccccagagggccagaagctccgggctgggacccgggtgaggctggtgtgtttggctatcgggggcaacccagagccctccctcatgtggtacaaggactcgcgcaccgtgaccgagtcgcggctgccgcaggagtcgcggcgcgtgcatctcggcagcgtggagaaatctgggagcaccttctcccgagagctggtgctggtcacagggccgtcggacaaccaggccaagttcacgtgcaaggctggacagctcagcgcgtccacgcagctggcggtgcagtttcccccaactaacgtgacgatcctggccaacgcatccgcactgcgcccgggagacgccttaaacttgacatgcgtcagcgtcagcagcaatccgccggtcaacttgtcctgggacaaggaaggggagaggctggagggcgtggccgccccaccccggagagccccattcaaaggctccgccgccgccaggagcgtccttctgcaagtgtcatcccgcgatcatggccagcgcgtgacctgccgcgcccacagcgccgagctccgcgaaaccgtgagctccttctatcgcctcaacgtactgtaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactatgctcccaccatccgtgccctccaggaccccactgaggtgaacgtcgggggttctgtggacatagtctgcactgtcgatgccaatcccatcctcccgggcatgttcaactgggagagactgggagaagatgaggaggaccagagcctggatgacatggagaagatatccaggggaccaacggggcgcctgcggattcaccatgccaaactggcccaggctggcgcttaccagtgcattgtggacaatggggtggcgcctccagcacgacggctgctccgtcttgttgtcagatttgccccccaggtggagcaccccactcccctaactaaggtggctgcagctggagacagcaccagttctgccaccctccactgccgtgcccgaggtgtccccaacatcgttttcacttggacaaaaaacggggtccctctggatctccaagatcccaggtacacggagcacacataccaccagggtggtgtccacagcagcctcctgaccattgccaacgtgtctgccgcccaggattacgccctcttcacatgtacagccaccaacgcccttggctcggaccaaaccaacattcaacttgtcagcatcagccgccctgaccctccatcaggattaaaggttgtgagtctgaccccacactccgtggggctggagtggaagcctggctttgatgggggcctgccacagaggttctgcatcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtctccaccagccttctggagaacctgaagaccagctgcccacagagccaccttcaggaccctcggggctgcccctgctgcctgtgctgttcgctcttggggggcttctgctcctctccaatgcctcctgtgtcgggggggtcctctggcagcggagactcaggcgtcttgctgagggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagcctggggacccctctacgatgaagtgcagatgggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatggagggggctgagtgacagagatggttcagctggtaccagagtagaaacaaggtgcatcctggggttggctttagaaactaaacttctccaaaaggacagggcagattgtaaacgtcgtctcaaaaatgaaatgctgccgggtgcggtgactcacgcctataatcccagcactttgggaggctgaggcgggtggatcacctgaggtcaggagttcgagaccagcctggccaacatggtaaaactccatttctactaaaaatataaaaaattagccaggagtagtggcgcatgcctgtagtcccagctacttgggaggctgatgcatgagaattgcttgaacccaggaggcggaggttgcagtgagctgagatcacgccactgcactccagcctgggcgacagagcgagattctgtctcaaaaaataaaaataaaataaaaataaaaaataaaatgctattctgagggtccctaagtgcttcatgaagtaaagttttcagaagtggggaaagacatatgaaaaactctgttcattttgcattccatgacgtctgaaatagctaataataagtggaatttatgaatccatgttgcatcctacctattattttattatttccgacagttatctaacacaggaggcataaactatgacacatgtaaacataagtatgctccataagcattaaaataaacagacaatcaaaagaagctagaggaaaagaatatgtactgtgtgtgtgctttcgtttatagaaattctaaaataggcaaaactaatctacggtggcagagagcacagcagaggtttcctggggccatgagaggagggttgactgcaaaaaggcatgggagaactttctgaggtgttggaaatattctatataacgattgtggtggtggttgcacgggtgcacagatttgtcaaaactcattgaactttacacttaagatgggtgcatttttattgtacataaatgatatctcaataaaagtgatttt

SEQ ID NO: 19746 - DNA, 1855 bp, Homo sapiens
cacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcggaggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgagatcgtgaccaaagacatgtttataatggagatagatgccatttgctactaccgaatggaaaatgcctctcttctcctaagcagtcttgctcatgtatctaaagctgtgcaattccttgtgcaaaccactatgaagcgtctcctagcacatcgatccctcactgaaattcttctagagaggaagagcatcgcccaagatgcaaaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgccgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatgcctgagggagacactctgtcctcattccctgcccttcctttggttgccatatggaatggccatggaatgcacgaagtcacaatgcaccatccatgagaagacggtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccaaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaa

SEQ ID NO: 19747 - DNA, 1670 bp, Homo sapiens
cgcggacccgcagcgactccacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcggaggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgccgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatgcctgagggagacactctgtcctcattccctgcccttcctttggttgccatatggaatggccatggaatgcacgaagtcacaatgcaccatccatgagaagacggtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccaaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaa

SEQ ID NO: 19748 - DNA, 3417 bp, Homo sapiens
agagcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagtgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaa

SEQ ID NO: 19749 - DNA, 1840 bp, Homo sapiens
gtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtacta

SEQ ID NO: 19750 - DNA, 884 bp, Homo sapiens
accccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaattt

SEQ ID NO: 19751 - DNA, 921 bp, Homo sapiens
ggctgtgcgctctggggcacctcatgcagacgggagtagggaggctgttttttgcgcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 19752 - DNA, 753 bp, Homo sapiens
gaggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagc

SEQ ID NO: 19753 - DNA, 805 bp, Homo sapiens
cggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagca

SEQ ID NO: 19754 - DNA, 913 bp, Homo sapiens
gcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 19755 - DNA, 2563 bp, Homo sapiens
aggtgtgtgtgtctgagggtgtgtgtgtgagtgtggctggccccagtacctggccaagcccaccacttccacctgggccctacacccccacaatgtgtacccctcttatctgccctggagcctgtacagccatgccacgctacccctgagagtctagaaagctggtcactaactttgcagacggatgagccttgagcacccagaggagactggggctgtcaacgctgccccttgtcctgccggcttggatcccctgacagggtccttctaggcttcagactggcaccctgaccatggaaccctgaagtggcagtgacttctagagctcagtggcagaccccacgacccttcctcccccttcctccccctcccaccaccagctttcaagctcccagagggaggggtggggaggggatcctgatctcacagggcagggggcttccatcatgatgctcaactcagacaccatggagctggacctgccgcccacccactcagagactgagtcgggcttcagtgactgtgggggcggggcgggccctgatggtgccgggcctgggggtccgggagggggccaggcccgaggcccagagccgggagagcctggccggaaagacctgcagcatctgagccgcgaggagcgccggcgccggcgccgcgccacagccaagtaccgcacggcccacgccacgcgagaacgcatccgcgtggaagccttcaacctggccttcgccgagctgcgcaagctgctgcctacgctgccccccgacaagaagctctccaagattgagattctgcgcctggccatctgctatatctcctacctgaaccacgtgctggacgtctgaactcagcctgtctcccacctcccgggcctctctggggcccctttccaccgctcactgcttagaaaggccgcatcctccccgagcccttataccttggcatggagtcccaaaggccctgggcacaggcagagagcccaccggctggtcatgagggcctcttcctttctctgacccaggcacctcgagggctattctcctgggttccttccggggtttattgctgaggcccagctgtgcagaattgtttgctagtgtggttggtatggaatccttgctggctttactaagccagccacacttggagtctgcccccaagctctctcactgaatgctgcctcttctacccctatgtccaaattttcagccaccacagacctcagctgtgtatcctatctgttctagcttctcctgcccctggtggggatgggctgtcagaattgcaagggaggaaggctggggttagagtggggagtgggcttcttcctccaagatctcagtctctcagtgcttggcagaggggtgaggccctggggaggcaggggttggtgccctgactcctgtgaggggaatctcagtagctgggaattatggaaaaactcttcctgtttctgtccatcttgttcctgtggcttagcacatacagacctcagatcttacttggtagtgagtgccttgccctctttgagctatttggctacttccctgtccctctgactcctactgtcccaattttctccctccctgtgtgtcactagagaaaaaaaaaaacaaaaacctagattccggattaggggatgacatcccaaacagcccggagtatttgcagaaggctcaggcaacgagtgggccacatctcacttctgcttcctcatctcagcccactctgaaaatgtgcagcaccctcactggttcctccccccaacgcaaggaggatgcccaattgttgccctctgaaaatgcacagttctcctggccctaggacttacttattacatttttttctctttccttgagctgcctttggcaagggaagagacccccaactctgcgcccctactccatgctgctgatccccacctgcgcactatagctcagggtcagcagtggaatgaagggccttagaacctgcatagaagaaatgaactcactgcatttctgtgctccctcctccctcgcaccaaactcctagctctacaagtatatttatttatttatttatttattcatctatttatttacttatttatttatttataaatattgctatttattgccgagttgtgcactttggggtagagtgaggggctcccagcagctctagctgggtctctcttgcttcctccctgcttacgcctttccttttcttgctccttcttcaactcctggtgtgtgtgagcatgccctttgcttgccacaccatatcctttccccagatccacctgtcctgacactctagtcctccaggatagtgctcctcccccagctccagggctcctggatgtccttcctcaactccctccacccctagacaatcctacctggtcccatctgcctcttttctctccccagcctgccctgtgacccttgcctcttcctgatactcccaagagcaggccccaggggtctgtgtcacatatctctgtgtgattccttctggttgcatccccaatttcatacaaaaagaaaaataaaagtgacctcgttctagcaccagg

SEQ ID NO: 19756 - DNA, 2512 bp, Homo sapiens
aattggtaccaggagagcccagaagccacacacgcatctctgcctctttgctctggctctcccaccctcttcccgtctttctctgcttccttgtcactgttactccaggagacgttcacttttcaccaacctttctccaagcatctccaagccactgactatatatattttgctacaagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattgtccctcgctgcggacaccagcgagatgacagctgctttttcatttttgaatgtaataaatatttgctgcttttaatattttccggaatctcccctcgctattccttggaattttaactctaaagattggagaacagattatcaaaaaggcttttgcaagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctgcccccggacaagaagctctccaagatcgagatcctgcgcctggccatctgctacatctcctatctcaaccacgtcctggacgtgtagggcggggtgcgccgcggggggccgcctgtcccggcgtccgcgaaacgctacggatccggacgggcgccgtcgctcgggtggcggaggctgcggtggcccagcgagacggccgcctcgagagacggccggggaagaagctcgctacctgttctctctggtcagcagggcgacgagggaaggtttccgacgcaggcaggtggggttgtctggcgagcccgggggctcgcaggggggattttccaggccaggagaacctcgtggagacacccgagatgagccacttctggggctccccaagggttgtggttttaacccactggagactttgagttctcctacattcatccgccacaaatcttaatgtgttgaaagaatgagggcagaagttcagagtatgcaggctcataactttaggctatctggaatttttctaatggacaaatcaccaaacactgggaaggaggagagaggagggatctctcccatagagatggaaggcacagaaaggtgcgactggaaactttcctttctgttgtgaaaataaagattatattagaatccaaataaaccctgaatatttagtaagtttaaaaagacaaattgagaacaagtagacacactgtgggaggatctgagcttggtgatattttatccccaagatatgacaccaaggtagacaggaaaatccatatttaaatggaaactttaatatctgattacttttgcaggcgaagtgcccctttatatatccaaaaacatctatttgtgaccttaaacatgtggacccataggtgcagttagaaaaagacaacctatttttatttatgttagaaggagtagagtatttttttcaagacatttatttttcagagtggtgatacttttactttggatactctgtgccaatttatttatagtcaagtgtttacactttttcctgtggaataattatgtctaactttttacgtgtttgttgagattatactgtggtctttctttctgctctaattatattgcacttgtataacaaatttcccacttctccctgtttctaaacatattttatatattaagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcctaaaaaaaaaagaaaaaaagaattcagaactactttcctctgtgacaccaaaaagaaaagtctataacctgaaaatgtttcatgttctctgctgtgaaactcttaaaacaaggagtgtattttagagacaagggaaaaaaaccacatctgctatccaaagattttagtctttttcagggtttttttgtgtctctgttgctttatataatgcaatattttgtagtgaaaatagatataatctggtttctatctgacgagtttttcatatctcatgaatggtgcgctgttttgcatataaataaaggtatcaaataaa

SEQ ID NO: 19757 - DNA, 7226 bp, Homo sapiens
gagtatatctggatatgtttatttttctatgtcaatatatatctgttcctcaatatgtatttatactgaataataataataatgatagccaacacttactgaacatgagttctaggcattagtttaagcactttacatatattatcttgttcaccttcagaaaaaaacatgacataacattacataacatgctttgattattctcattttacagattagaaaactaaggtccaaaaaggttaagtaacttacaactaaattcacacagctagcatatgacagagccacaaagccggactttttaagtcactacttatcacctccccattcatttaataatattatttaatattactcttatagtctataatatcataatttgtatggtgcttactatttcatcaaatattttcaaatacattgggtctcatagcgagcctgtgaaatgagaagtgcaatattattattctcatttttacaggaaagaaaattgatagaactgaaccatgggtgtcctttagtggaagcgtttctatgttacaaatatctggggtacctctgtacatagagtcacatcataaatgaactgagtacctataatgtgtcaagctcagacattagtgctggggatataagctacagacctcccctggaagcatcatagcctaggaagagagaccagtgtggtaaccaagaaccaagaatcacggtacacaatatgtagtctctaagggagacatgaaaggagtgcttatggagcacagaaggaggggccatctgtgccagggaggtcttagaaaaggcaaaggggtgggggagggggaggctttgatggaagaaagaatgtgtgtgtgtgaatgtgaatccatgtctgtgtctatgacagtgtggctaggcatcactaagtatggatctgagtgtgtacctgtttatacaggcttacttctgtaagcattaatttttgtgtatgctggctgctggtatagaatgagtaagcctgaacataaaagggaatttgtctggtatcacacacaccatagcagaattggacctgccctgataggcacaccctgtcatgactccccaacaccaggggaaccagagatgctggtcctttcccactgtagcagctgcccactctagagctatggtgattagacccaccagtttttttcaatccatcagtatggatgtgtggtggtctaatagagccagccagcttgtatgatgaagggggaggaggtacaggtgtctgtgggtgtgcatctgtgtgcacacttctggttgtgtgtgaatgcttagcattggctgttcctaactagagtgagaaaacctcccttctcccttcattgtcaccaccttggggtgtttatccactcacccatttccattgccacctgtatgggaccggcttccatcttcactttaacgttctggggatatctaaaatatacctctgtgctggggttaggcagaagcaaggctggggagtgttggtgcccttatttgttggaggcactccctcctttccccgacccctgccccattgtggtccaggaatctctcaaaggagcaaaaatgtgggcaaaggcaaatagtacttgtggaagccatgaaaaacccggagggtcactcccaggggtgggctgctcaatgtgcctcccctggtgataaaatctgcttttagggcaaaattaaggaagacaagtgaggactcctctctccacaaatgttcccctaggaactggcggggtgggagtaaggctgtaatgctcttttatttctttaagcttgtatgatcaaaacaagctaaaataatcacaaataatatgttattgatattaactatgagtatcttcataaagtggcaaaataattgaactagattttattttttattataaggtatacaaattcagggccatgggatcatgtaaggcaaaggcattatgtactgggacacactggtaatttgtgtttacatcttggcacaagcactgccacgcagtacaatatattagcatgttaagatgggcaagaatgaagtgcaataatcaacacatgtagcatgtcatatttcagcttgaatgaatgagtgggtggagagaaaaacaaacatacagaaaagtagaattatctcatgtcgtggtccgtgaatatgtggattctctttctagttccaccaatggcttaatctattgaaaggttcttaccatctattgataagttagtctcatagcagatcatttctcaaaaatgttaatatgcttaatcaaaccttactgaagtatcttttaaaatgtaaatgatctctaataaatgttggctgttgcatgtctaaatactttattgcagcatcttatatagtatatatttccatgttctggacacaaatatttttctaaatattaagggaaagtggtggctttgtaatatgccaggggaattctttgatagtcaatatattgtttatttgtacttaaatatttcatcaataatctggaaaagagaaatagcctgactacggctagatactgtttagaggctaagatttctatcatgaactgcttttcaattgttatattttatggcacagattcagtgggaatctgatctgctaaaatatttgggctgtgaaaactcccacactgtgacagatgtcaagtccaattaagtgactcatgtccaggtttctgtccaataggatttcccattaaatatcaatttaggggaaaaaaattccatcccccttcctaagcctttatctcttccaccatctccaggctgaatcaattggtaccaggagagcccagaagccacacacgcatctctgcctctttgctctggctctcccaccctcttcccgtctttctctgcttccttgtcactgttactccaggagacgttcacttttcaccaacctttctccaagcatctccaagccactgactatatatattttgctacaaggtaaagagaagaggggctggggacgggggatatagccaaaccttgaaagactttgaaactggaaaataggtgtctatttatacaacatacaagtaagtgagggaagaggaagaggcaaccttagctcctagttacagtattgtgttcctgggaactggggagatatcagctgaacaaagccttatctcaaaaaaaaaaaaaaaatcacttctgagcaagatcacatctctgtcctgcacttcccagtttctgctcagccgtattaaggaaaagaaaggcatacgataggagcggaatcttatcttaaccatctttcttattgattattccgctattagaaagtggaggaatcagccctttgatgtgattgtgtttatctctgcatctcttttgttatttttagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattgtccctcgctgcggacaccagcgagatgacagctgctttttcatttttgaatgtaataaatatttgctgcttttaatattttccggaatctcccctcgctattccttggaattttaactctaaagattggagaacagattatcaaaaaggcttttgcaaggtaagactcctttaaataatttttttcagcttgaaataagttagattattcatactgtatctatagatgcagttcattccataaagagataaaacgcatacacggcatactatttatgaatatttttaaagatctagaggagaatttaatgtgctttgagggcaacccaggaactttttaccagaactacaactatttagtggcttattgtgattttccattactcgtctatttatttctgccctttcaagctgactgtgtaggtgcaagttgttctactcataaacgtacccgagaaaagcccgtagggagtcacatgcagctctctgggagcatttgtttttattttgccgtagaggacctgatttcctcgcagggaaattaaagctgttttggcccaattcgctcctctgcaagtgcggtgctgggaaccgatcacccatccccttgcttttgtttctctagaagcaaacgctcctatacgtcgccgacgcggatttctcccgtgccgagcgtcgtggaggctgcccacgccggggccccgagttctcagcctggtcctcactcccgacgcccaggggcggtgcgtgcagcccctgcaggggcctttctcctcctgccgggccctttctcgaagcccgaattacccggaagcccagcggttctgagcggccccctcccagaaggcgcacagtccgggccagtgctccaggcgccccagagaagcctggccaggtggcgtttccaagagggcacagttaagttagaggaaggctaagcaccgacatgcccggacttggccaggccacccggggacagctgcagcctgccgagctccggttccgggagcgcccgaactttgccggcagagatgcagctcccgccgggacaacacgcgctgcacccgctagtccccgcctgccccgccccgggcccttcccttctcttcccttccctctgcatcctctcctccctcagcggcccggctgccggcattttcccgcaaggtggtcgccagactgccgggcgcattgtctgatcccacgtcgccgtgtccctaggtcccctatgtgtgtggctgtctgcgtgacagatggtgctccgggagcctgcgagggcatcggagtcaattttctttttaaaggctcccccacgtttgtttagtcatttctttacgatttcggagaagcgcgaggggtccaagaagccttcccgcccccagccactggctctccgcctgcgctccaggatggggattcctgaccggccgcaccccagagccaggcgcccccggcgcagccccagaccagcgccaggccctcgggcgccgcggctgccgggttgcttcgccggaggccctcggggcgagaagtgcaccccgcgtctccccgcccccgtgaaaacccagatgtattcgttgttcgaaatcgctcgtttgtccgggaaggggacgaagggagggaggaggaatagcgcggttggcatttggccggaagaggcacaaaaacccagtcgcgaccccacaggcctgcggttgttccccaggcccagggccacaggcccgctgtggccgtctgcaagtcgaggtgtccagtctagtatgcggcctgggtcaaccgcgtccccgccggctcccgcgccagggcgaggcgcagggctcgcgccctcgggccagatcctatcggcgccctcccgcgtcgcgcgccggcctgctgtggggagggggcccgggccgcgcgtccgctgggaggaccggcgtggtaggcctcggcagccatccttccagcaaaataccctgattccttttactgattaattttccgacccctcctcagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctgcccccggacaagaagctctccaagatcgagatcctgcgcctggccatctgctacatctcctatctcaaccacgtcctggacgtgtagggcggggtgcgccgcggggggccgcctgtcccggcgtccgcgaaacgctacggatccggacgggcgccgtcgctcgggtggcggaggctgcggtggcccagcgagacggccgcctcgagagacggccggggaagaagctcgctacctgttctctctggtcagcagggcgacgagggaaggtttccgacgcaggcaggtggggttgtctggcgagcccgggggctcgcaggggggattttccaggccaggagaacctcgtggagacacccgagatgagccacttctggggctccccaagggttgtggttttaacccactggagactttgagttctcctacattcatccgccacaaatcttaatgtgttgaaagaatgagggcagaagttcagagtatgcaggctcataactttaggctatctggaatttttctaatggacaaatcaccaaacactgggaaggaggagagaggagggatctctcccatagagatggaaggcacagaaaggtgcgactggaaactttcctttctgttgtgaaaataaagattatattagaatccaaataaaccctgaatatttagtaagtttaaaaagacaaattgagaacaagtagacacactgtgggaggatctgagcttggtgatattttatccccaagatatgacaccaaggtagacaggaaaatccatatttaaatggaaactttaatatctgattacttttgcaggcgaagtgcccctttatatatccaaaaacatctatttgtgaccttaaacatgtggacccataggtgcagttagaaaaagacaacctatttttatttatgttagaaggagtagagtatttttttcaagacatttatttttcagagtggtgatacttttactttggatactctgtgccaatttatttatagtcaagtgtttacactttttcctgtggaataattatgtctaactttttacgtgtttgttgagattatactgtggtctttctttctgctctaattatattgcacttgtataacaaatttcccacttctccctgtttctaaacatattttatatattaagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcct

SEQ ID NO: 19758 - DNA, 855 bp, Homo sapiens
acttctgagcaagatcacatctctgtcctgcacttcccagtttctgctcagccgtattaaggaaaagaaaggcatacgataggagcggaatcttatcttaaccatctttcttattgattattccgctattagaaagtggaggaatcagccctttgatgtgattgtgtttatctctgcatctcttttgttatttttagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattgtccctcgctgcggacaccagcgagatgacagctgctttttcatttttgaatgtaataaatatttgctgcttttaatattttccggaatctcccctcgctattccttggaattttaactctaaagattggagaacagattatcaaaaaggcttttgcaagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctg

SEQ ID NO: 19759 - DNA, 2738 bp, Homo sapiens
gagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagcgtaatagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggtt

SEQ ID NO: 19760 - DNA, 3943 bp, Homo sapiens
gcgcgcggcgggggcgggctttgccgagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaa

SEQ ID NO: 19761 - DNA, 1842 bp, Homo sapiens
tggagcgccgttcgccggtatgtgcgcatgcgttgaggtctcttgacgccgattggggggtcacgagtcacgggcggcgtgcggcggctggtgggggcgtgtccggcggagcgggcgcggcgttacgaggccgctggttggccagcgctagtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatgagtc

SEQ ID NO: 19762 - DNA, 3837 bp, Homo sapiens
gtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttctttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgatcctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaa

SEQ ID NO: 19763 - DNA, 3756 bp, Homo sapiens
aaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttctttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgatcctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagc

SEQ ID NO: 19764 - DNA, 1331 bp, Homo sapiens
gagggggctgtggcggccgcggcgggcgacatggacaacgcggggaaggagcgtgaggcagtacagctgatggcggaggccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactag

SEQ ID NO: 19765 - DNA, 1366 bp, Homo sapiens
agagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactag

SEQ ID NO: 19766 - DNA, 3615 bp, Homo sapiens
ggacgggacggagccggggcagccagaagaggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctga

SEQ ID NO: 19767 - DNA, 1971 bp, Homo sapiens
ctagagggagtctactgctcttaggaatgttccgggagaaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtg

SEQ ID NO: 19768 - DNA, 1818 bp, Homo sapiens
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcagtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtag

SEQ ID NO: 19769 - DNA, 4703 bp, Homo sapiens
ttattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtagtaagtaaaaacaaaaacaaaaaaaacaccaaaccaagtctaggctagctttgctttgttgttcacctcctcagatctattttcccagtgtccatttctgatgtaatagggtattttctttgtgaattgcatttttgtgttggttttctgcacagatctggtgagaacacagataaagtgattatttgtgcataactccatgaacatggcagtgctatgacttttctgactactcttaaccagtgagggctacctagactcaggtgcaattccttagataatcatcattcaggaaaaatataagtagtcctatttatccatacttagcaaccaacaaacaaattgaactctctcttagactggatttggatgtctgacataattttaaaaagcagaaaatgaaagccaatgaatgccttgggtatatgcatcagaacccaagaaaaagtccatgataccaagggaagggaattttgttaatgcattaaattctatgttttgtgaaggcctgaaacaggcaaatttgtgatcagtagtctctctggagagataaaggaaaaagagaatctgtacattcatttctccttcctaaaatacgatgatctatgtcttcttgactacttagctttgagtttgatatagaaagagtataaaaaatatgtgcagaatttgggagtgagagtactagaaattcctttaataaatctgttagtatgaatccaagcaattgaagagaaaccgctcttcaaccatctgtagaacacttccccagtatcactacaaagaactttcttccagctatcatgggagaaccaggtgtagctcccgcttcatgtgtaaaataatgatgccctcatgccaagcctgaaattcacattaagaaaatgcccagtaactttacagagcaaaattttaaatttttttttatacattgcaccctttatctctaatggctaaaatctttgaacaactactaagtaactgattacaaataaattaccgagaaagcaagattacgcatggtaagcggagagaattttcactgtagtgtcatcccctcacaggcttgtgtcataggtgctgtgccaggcagggtgatcgcagtgtaaatagccattgaatgattgcgattcccagcatccatctaaaaagcaatactctgataatttggataaagcaacttcctgcttcttataaatgcacagtcaggtgtcccaatttataaatcaacccagtttacttgagcttgtgaataggcctggacactgatttgttaagcgctagatgtggtaaatgccatgaaaattggccactttgtaaatagaagtagtgttcacatccatttagagataccagcctaatgctacagcatcctctttgtgatcttgttgaaacagcatcagtgttaaaaacttgcaaatgaaaaccttcagctctaatagtctaatttttctgctttagtatcccccttggcatttgcctaactgtatatataccccacaatgtgctcctttcaggccttgacaattgcatttgcacgtgcattttagtgcaacagggaagcaagtagaagcaagctgacacagattattgaggctgctatagtgatctggcctgtcagaagtttcagaaatggatggatggaaaagtagttctttggcgttggggtgtctttctgtttggagtgtcagttgtatgttgcatggcccctctaactgtactgctcactcgacatcccattcggccgcctccaccacattccccatatctgagcatcagcagatgttgaccttttacacatcaaatcaggaaatttctgttttgttttgttttgttttgttttgaaatcagtggtgacctgaaaggatgcttcgttgtgcctttgaaaaaaatatattaacctttattatcgagaacctaggaaaatttactcctaataaaaaccctctgactaaaagtgatattttggactctcccttcaatatgcctctggctgttccgcttagaatgcaatgggtattttctcagatttccagcaaacaggatgtaagagcttccagaggtcacccaacatcacacatgactagcttacctgtttcctggcttttaaggtaaagagttacagtaaaaccatcaaacgtgattgtatcttctaggctgctttaatggcattcgaaagttccttctttgtgggcttataagttgctttttgcgtgcactcgtggattcctttcccctccaaagggcaagaattcacacgtagacgacactgcctgttccagagggcacgggaatggggttttcaaggtgcaagccagagaaaaggaagctgtttggatatttagctaagttatgggtgtttgccagtgctttttgcattaccccaaagaaggaatcaatgactataattccactaactatatagaaagataccattatagcagatgtaacacccctgagaccccgattatcacagcatagctcaaggaaaataaatgatgtatattatcgatgtagattattgatgtatataaccatcagtttacatacatattctgtatacacagtgattaaaggttttggggccctaataaatttcagtatagatctcaaaatgccaacgcctgtattaaggttcaaatgcatggatagggtggtcatcctttccgatcatctgctaaaaatgtttttgaaacaaatttcccattaaggtcattcgtacctgctgttgtctatctattaacaaataggtttcccataatcctaaggatacttgacttagaactcagtcattctgatctgctttggccatggctgaaaaaatgctggtgatattgtcagcaattaatgaatcccaaaataaatctgtagcctttg

SEQ ID NO: 19770 - DNA, 2856 bp, Homo sapiens
aggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtc

SEQ ID NO: 19771 - DNA, 2916 bp, Homo sapiens
aggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagttgctcccaaattagctttgtcaacagtttcttctgttcaagttgcaaaccacaagagagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtc

SEQ ID NO: 19772 - DNA, 3084 bp, Homo sapiens
aggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagttgctcccaaattagctttgtcaacagtttcttctgttcaagttgcaaaccacaagagagattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtc

SEQ ID NO: 19773 - DNA, 1485 bp, Homo sapiens
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 19774 - DNA, 1443 bp, Homo sapiens
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagttgctcccaaattagctttgtcaacagtttcttctgttcaagttgcaaaccacaagagagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 19775 - DNA, 4628 bp, Homo sapiens
gcatttcggaagaggacgtcaacgggaaggaattccccctctgggtgcgggctccgagagggggcgacttgcaggaggctccccccgggggcggaggcgaagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacgatttcaggaatttgtattgcaatttcttaagatgaaaggaacagccaccaagcagtttcacactcactttactgatttctgtgtggactgagtacattcagctgacgaatttagttcccaggaagatggattgatgttcactagcttggacaacttctgcaaaatatgagactatttccacttgggaaaaattacaacagcaaaaaaaaaaaaaaaaaaaaaaaaaaatctaagtgattgccaagattatgccaaagcctgttggcagagtactaagagacttttatttttaagtcatgctattttcacagattgatggtgatcatgtgactctagggatgctgatctatgtatctttccaaatacagtgtttacatggagtatcacaagacgcaacctggggaaccaggaagggagcagggaaattgagtgatttgcaatttgactttgaatatattcagacttaagtatttagaggaaatatcaaaatataaagcagcaagtagacataactgctgttcctgagaataaagtttgttttaagtgctgcccaaggtgtaataaattcttgtttctgccttttattaggccaattactgtgcaagacagcaaggggaggcaggtggggaagaacctttgcaaagtttcaaagaggctaagacagtgtgcatttcgttcccagcacactgttgtcctacagattacaagtgtattagcagcagcatctcctggaatcaaaaacaattatcagcccgaaccagagtcttaaggacaatgaaattctacatgacttggtagaacaataacctatgatagtgtaaggtcagaaacctagttccagtctgaattcttcaccctgctgccactccttgctgaaacagggaaggggggaggaatgtctcctgataaataacctgggtaaaaactagatgaaggaacagcatgtcttattggttttgttcccagaaaagccaattcgaagaaggcaataaaaggtaaacaggtaatgcctgtgctgcctgccaccccacgtctaagtctattgaatgtttgttattcaaaccaacagtctcttttgatgtaagaaataaggaaagatggaaataaattagagcttaggcttagtgccagagtggccaaccagaaattggagatttacgttggaagcataaatagaaaattatatttcaggctcaccaaagaaacacatgaaaatgctgataacatagggagtttgagattatttataatgaggtggatttctgatattaaaattagagtttaagttgtcttatagtttattagcacaaaccaaaggcagcccatgttatttctggcaaagatgcactttatcgttatctgctcatggctttgtcgcaacgctcaggaatcagacactgcacacttcaatagttgggattccaaaagctaattctaaaatttaatgaaggcctgatttaaactgattcatctgcattttatctttatgaggccataagaatctaaattgatgaggaatatctttcattccgtgtatttagatatagttttctgaatttcctgaagcgatgtgatctgcttttaataaaaattcacttttaggt

SEQ ID NO: 19776 - DNA, 4034 bp, Homo sapiens
taaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacgatttcaggaatttgtattgcaatttcttaagatgaaaggaacagccaccaagcagtttcacactcactttactgatttctgtgtggactgagtacattcagctgacgaatttagttcccaggaagatggattgatgttcactagcttggacaacttctgcaaaatatgagactatttccacttgggaaaaattacaacagcaaaaaaaaaaaaaaaaaaaaaaaaaaatctaagtgattgccaagattatgccaaagcctgttggcagagtactaagagacttttatttttaagtcatgctattttcacagattgatggtgatcatgtgactctagggatgctgatctatgtatctttccaaatacagtgtttacatggagtatcacaagacgcaacctggggaaccaggaagggagcagggaaattgagtgatttgcaatttgactttgaatatattcagacttaagtatttagaggaaatatcaaaatataaagcagcaagtagacataactgctgttcctgagaataaagtttgttttaagtgctgcccaa

SEQ ID NO: 19777 - DNA, 2721 bp, Homo sapiens
aggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtgatccctatcttacctcatgtggagatcctccaaagtttaataggatatggccgaatatttcttcccttgaggtttctaacccaaaacaagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtc

SEQ ID NO: 19778 - DNA, 3149 bp, Homo sapiens
gaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagttgctcccaaattagctttgtcaacagtttcttctgttcaagttgcaaaccacaagagagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagattt

SEQ ID NO: 19779 - DNA, 2823 bp, Homo sapiens
aggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtgatccctatcttacctcatgtggagattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtc

SEQ ID NO: 19780 - DNA, 3326 bp, Homo sapiens
gaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagattt

SEQ ID NO: 19781 - DNA, 2932 bp, Homo sapiens
tgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaac

SEQ ID NO: 19782 - DNA, 1829 bp, Homo sapiens
gaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtagtaagtaaaaacaaaaacaaaaaa

SEQ ID NO: 19783 - DNA, 2655 bp, Homo sapiens
aggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctatctgccaagcatgtactctgtggcagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtc

SEQ ID NO: 19784 - DNA, 2958 bp, Homo sapiens
aggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtgatccctatcttacctcatgtggagattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtc

SEQ ID NO: 19785 - DNA, 942 bp, Homo sapiens
gggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaagagcaaatgcctcctgttgtccttggtcaggggttctgtctacctggggacccctgtctgcacaccagggatcaataagagccaaagtgggacacctcctagatgtcagtatcagctggctgggcagtggaattttgagcgacctttactttatacttttctgtgcttgacagattttcagccatgaccatgttcactttataatcaaaacaaaaataaaggtcccatttttac

SEQ ID NO: 19786 - DNA, 2088 bp, Homo sapiens
atgagcctcctcctctccttctacctgctggggttgcttgtcagtagcgggcaagatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataa

SEQ ID NO: 19787 - DNA, 8135 bp, Homo sapiens
gctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagatactcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggtgtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctggatatatttttaacaataagtttgttagcattatttatttatctttagagagaaaatatttgcatctgtttatttaccctttgaagcattaatacttagtcactcacattgaaattgcatatggatgtatcaacataggctaaaattaaattatggatgtcgcagaaatgaaatacttcatcttagaaggtaaaattttcaagaaagtattttattcatggacttaataatgtcttaagatgaaacaattttatgtccaaatgagaaatttataaaaagacccacatatagtagttgctgaacaaacataattttcttccagctcccatccttcctttttgaaaaattgaatttacccatgtagatgcagctatttacaattatacaagaatgcgaatagattaattatatcttctcatataaaggcaaagaattttatattatatataatgctaaatatttatttgataacacaatattcttagaaaaatagtttattactttaggattttatctataacataaatatattatttgttattacctctttaaattttcattttatacaatttttgagattctggccacacaacattcagaattattgctcatgtaaatttaaatattgctacttattttttttcttttctgaaatgaaaacatgaatcttttggcatctgtttttagcctcccatggaagacagtaagcaaaaccatcactgttggagaatttcaaatcacaacccgacataggagagtagagaaacaaagaaatgagtggatctagaaaggcaaactgaattgctatatttggaatagctaagaaggacctgactttgagaagtgctagaccagggactaggaacgttgcttagataaaaattatggccgattacactgatgcgaaggagaaaacagtgtaacacagaggagaaagttaacagagatagaatctatgatttaattttgcaaatagtttttttagagaacaacatgcatactataaaagaaatgatactattaagaacaaacctacttgttccaactcttaaagaaatattcatggtttagcatttgcctctaaaccctgttagaaatatgtgaagttagaaataaaggtttttttaaaaaaaaagcttttttggtatgtgaactgtatgctgtgctcagtatgtactgaaacatactatcttttattttctttaatttatatattccattcaaattctatattcttaagttagctaccacaacgttttcttattgtttcaatatggtatgtcccaatgaaatgctgtatatatatgtctaaactgtaaaaattatactgcaaatgttgaagttttgtatttatgagagacattgaaagtatggcttacagtatatcaaacttgtcacacttcaccatttgtatattaatagtaaagatacttttactttaa

SEQ ID NO: 19788 - DNA, 1494 bp, Homo sapiens
agccagcactagtggacttcctgaaatctcgcgccctgtcccacaccggagctggtaccgctgccttctacttcagcacatggaactctgcctccgcagttcttagtccgtacccggcatttcaacaaaaatagttatttgaagagtaccacgatggtgagatctgattcaggaggacaagtttaccttgattatcacaacaggcaaggtctctttgttgactggaaatacaacgaagcactttatcttgaagaagggcaaccagagacttattacaggacagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatcttaaacagatttcttggcattcttccagttcattttcaacatttccgaggcgttactttactaagaagca

SEQ ID NO: 19789 - DNA, 3620 bp, Homo sapiens
gaagtttaacagtccaggcgggagccggaagcccagcgcggagccggccgcggccccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattactttta

SEQ ID NO: 19790 - DNA, 2490 bp, Homo sapiens
aggcgggagccggaagcccagcgcggagccggccgcggccccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgagcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggag

SEQ ID NO: 19791 - DNA, 3366 bp, Homo sapiens
aagtttaacagtccaggcgggagccggaagcccagcgcggagccggccgcggccccctgttgtgttgctgcggagaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattactttta

SEQ ID NO: 19792 - DNA, 3162 bp, Homo sapiens
aatgtgagccatttttgaaagctactctgtaagctatactcattgcttgtcttcttagtgtgttagcttttataatcgcaattcttataatagtctagtgctatagatgttcatggattgtttgatgctccataactcctcatttagataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaa

SEQ ID NO: 19793 - DNA, 581 bp, Homo sapiens
agcgcggagccggccgcggccccctgttgtgttgctgcggagaggtacttggatgcattttacagcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacact

SEQ ID NO: 19794 - DNA, 582 bp, Homo sapiens
aacagtccaggcgggagccggaagcccagcgcggagccggccgcggccccctgttgtgttgctgcggagaggtacttggatgcattttacaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 19795 - DNA, 554 bp, Homo sapiens
agtccaggcgggagccggaagcccagcgcggagccggccgcggccccctgttgtgttgctgcggagaggtacttggatgcattttacagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgt

SEQ ID NO: 19796 - DNA, 595 bp, Homo sapiens
aacagtccaggcgggagccggaagcccagcgcggagccggccgcggccccctgttgtgttgctgcggagaggtgaggttccggaggccctgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgt

SEQ ID NO: 19797 - DNA, 2367 bp, Homo sapiens
gggaagtgtccggggaggcgcgggccggggtcgcgcacctcccggagccttgtggggtgtgctgcctccgaaaagtttgcctcgtctccacaagtctgtctccttttttgtcaacctcaagtacttttcttttggcaggtacttggatgcattttacaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaa

SEQ ID NO: 19798 - DNA, 7019 bp, Homo sapiens
gctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 19799 - DNA, 5760 bp, Homo sapiens
ctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 19800 - DNA, 6751 bp, Homo sapiens
ggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatccc

SEQ ID NO: 19801 - DNA, 7235 bp, Homo sapiens
gctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 19802 - DNA, 8161 bp, Homo sapiens
gagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19803 - DNA, 8416 bp, Homo sapiens
gagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccgaaagctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19804 - DNA, 8281 bp, Homo sapiens
gagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19805 - DNA, 8378 bp, Homo sapiens
gccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19806 - DNA, 8413 bp, Homo sapiens
gagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19807 - DNA, 8473 bp, Homo sapiens
gagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19808 - DNA, 8300 bp, Homo sapiens
atcagtataagtagcgagctgggcgcattccttctcagttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19809 - DNA, 8406 bp, Homo sapiens
gccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcgggagagtcccgtattctcagagtaaaagttgtttctggaattgatctcgccaaaaaggacatctttggagccagcttctgctccattgctgttgaacttttttttggtcgtgacatcagaaaaataaccaagtgtgagtctgataatagcaatgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19810 - DNA, 8346 bp, Homo sapiens
acatttgaatttgctcccgattcgagagaggcaggcatccgcggcagcagcttccaacccagacaggcttaagccgcgcgagggtgcccgggtgggtggctgcgcagggccctacctgggcgggagcggctgcagagccctgtccacgcggtgcctccccagcacggcacctcccactccaggctgttggttacctggccgggagctggcggagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19811 - DNA, 8436 bp, Homo sapiens
attttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatgatgaagcattgcatgaacccagaaaacggggatgccaaagcacagggcttaggtgctgttccttgcgtcatcagcagaggtctgtccactttgtagaagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 19812 - DNA, 3341 bp, Homo sapiens
gggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgttccagagagatgggcaagtgtcctatttcttagtgagagcctctaaacaaaccagcttgtgaacctccactgaaaagatctcatctgatgagcattttaataaagtgtcctgagtttggaggcttgccgtctttctcttggataaatatcttcatctcctagacttggaaaaacacattttctcctggggtttcccattggcgtgtcttgagctgctctggtgataaccgtaataatgccaatactgatacgaacagcagaaaacagtaaccccaagaactctacagatgatcatcaaggaccactgtctcttaccatttgctgctttggtttgaaattctcactgcctcgtagatctcattttgagcactatacattcctaaagattgatttctttctatctgacttaaatttaggaatgattaaatcttcatttctcccatgatttgatcctaaaacattttgaaaggaaacagccttgagatctgtgattactaagacatacataacattcttatcacattagaaagcaagaattgactgttgcttgtcttgttcctgttgtcttgtcccctgaattcctgtttatctttgattgtatgtgggacattgtattttcagtacatttgtagaaataatgtgaagcctataaagatgttctctgcctccagagagaattttgtttccttctgccagcctcataggcaagcatacatctgattccatgctttgagctgttctggcaaccctgatgtcttcagcctgtgcaagggtgggtttacttccagttaatccttattttggatacagtccttagggttccaacccaaagtcgggggtggtttggggtccctgccttggtgagccctatagtccaatgttcccccttacccaaagaagctgtagaaaacccagcacagcctcccaggcaccagtttcagatcagcaaaaaatagcaaatgcccccaggcttgaaaagcaatctcacctctattaactcttctcccaaagtttgacctagtaattctttattatccttgaactcttgacactattaagaagatcttttcggctgggcgcagtggctcacgcctgtaatcccagcactttcggaggccgaggcgggcggatcacgaggtcaggagatcgagatcgtcctggctaacacggtaaaaccccgtctctactaaaaatacaaaaaattagctgggcacggtggcgggcgcagtgggcgggtgcctgtagtcccagctactcggaaggctgaggcaggagaatggcgtgaactcaggaggcggagcttgcggtgagccgagatctcaccactgcactccagcctgggcgacagagtaagactctgtctcaaaaaaaaaaaaaaaaaaaaaaaaaaaaaaaaaaaaaaaaagatctttcctagcttttcttcatttttttaagttgtcttcagcaagatggttaatctcaattacctagtccatgatttctggaagtcaaagtcaaaaggtaaaatctatatagcctaggtgacaattacaataacaataacaatagctaaggcttattatggctttatgccaggtactttatgcacttgatctcatttaatactcatatagcctatgagggaagtataatttccattttacctatgagaaaacaggcttagaatggaacctttgttctcatagcttgtgagtggtagaaccgggatttagatccagctctgcctgagtccagcttctgtttgtcaattacttccctcttcagacctaattcttccaataagcaacagaaaaagacccagtggggccatggcctctggcacacagcttctcataaacgagcctatcacacatccccagaactaaagcaatcgtatgttccttctgatgttgaggtaaaaagcagggtttgttttggtttcccttttccaaaacactcccccacatgtttctggcttgtggttaagaagaacccaggtgttcatgtcacatacgagctcaactggggaaaaggaaaccatccagcagccctccttgcctgccaatagtggcttcacccaacttggggtgcattcttctacagtttctgatttctcaacttcacctaacattcccttgccttcttggatccctctcttgcccaacactaccatgcatggctgatagggcactgttctgccccatatcccatgggttctacttaacccagagctggcttacctggaaaccaagcttattctgtagtggcagacctcacgccatcttgcttaatagccttcagttttcctttagttgattaatgtatcactcaatagattatgcaagacctactctgctaggcactgtactaggccctgtggtttatatttaaatgaagagggaatgatctctgactttaaaatgctggaagaagagatgagatgcatcaagaccgtcaaaccacaagtgataagtgctgtcagagatgtgtggatcactggctcagggagttccaaggatagagacatattatctgtttgggaagggcttggtgggggaaaggcattcagccgggccttgaaaatcaattaaagtttgaatatgaggaaagaaagaagagcatctcagacaaggacatggcatggatgaaggcacagaggtatgggcgtgcagggcatctgtggaaatggacagctcagttctcgccgagggagggagttggtgcagagcctgggggccctgccttcagaagat

SEQ ID NO: 19813 - DNA, 4536 bp, Homo sapiens
acaacagtgagctcagagacttgagggaggcgctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcaccttagtaagcaccttctaatgctgcattttttttgttgttgttaaaaacataccagctggttataatattgttctccacgtccttgtgatgattctgagcctggcactcccaaatctgggaagcatagtttatttgcaagtgttcaccttccaaatcatgaggcatagcatgacttattcttgtttggaaaactcttttcaaaactgaccatcttaaacacatgatggccaagtgcccaaaagccctcttgcggagcaaatttcagaatatatatgtggatccaagctctgatagttcaggtgctggagggaagagagacctgtgtgtttagaggccaggaccacagttaggattgggttgtttcaatactgagagacagctacaataaaaggagagcaattgcctccctggggctgttcaatcttctgcatttgtgagtggttcagtcatgaggttttccaaaagatgtttttagagttgtaaaaaccatatttgcagcaaagatttacaaaggcgtatcagactatgattgttcaccaaaataggggaatggtttgatccgccagttgcaagtagaggcctttctgactcttaatattcactttggtgctactacccccattacctgagggaaactggccaggtccttgatcatggaactatagagctaccaggacatatcctgctctctaagggaatttattgctatcttgcaccttctttaaaactcacatatgcagacctgacactcaagagtggctagctacacagagtccatctaatttttgcaacttcctgtggccagtgtgtataaccccttccactatctcacagatagtcacagcgtccattccatagtctgtctcctcacatctgttagtattgacacagcacagacaccacaagccatcaggttcttcatggggcaggtgaaatacttctaccccatgggtaaatgtattcacatattaccaagagaagaagcacattatctatgatcttttggcccagttcttatttagcatttttattccagcctacttggaaacatgtttttatttgcaatatatgcctgactgaattaagcttgcttgttttaaacaaccaaatcattggaacagaaaaggatttaaaaaacaagaatgcatgatctcagagtgattaaaaaaaaatcagtggaaataaatgatcatagaaggtgcttttcaaaacaactgctattataattctcaaagtcctactctgccaaaagaagattaaaagtcatacattacattacaaggaaatgttcatgtgggaagagggttgctgaaaatcaacaacgcttgaagttaaaaagtgtgtctttgtagatttcattgtataatgtgtatttcttaggagatggctgacttgattgatctacgctaagtggagacatttcacatttttaaaaccaaatgttcaatctgtattactctttgccgtcttgtatgtagaggctatttttaaatcattaaatttttagatctctgttttcata

SEQ ID NO: 19814 - DNA, 470 bp, Homo sapiens
aaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggagagaatgaataatggggaaagaaactgaagagaaagtaacaggcaaggagatatttgcagattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggaatcttatggcaagggccttatatgacaatgtcccagagtgtgccgaggaactggcctttcgcaagggagacatcctgaccgtc

SEQ ID NO: 19815 - DNA, 3211 bp, Homo sapiens
acacatacatatgccactcacatccgacgtgtgtggttgctcagtagggaaatgcttacagctgcctctagaagcaagtccgctcgctgcatggagagggaaacatgagcatgcagcaggactagctgtcacctcccgcccgcctgcccagagagggccagagcgtcggggaggcaagatgatccaccagcggttccatcctacacttggattcagtaagctgtgaggtccgtaatgtcagacactggcaaacatcatatgttcttcaagtagagttatgaaaacgaagaaactggtcagaagagtaaaacgccggaattgtcctttccaacatccagagctgcatcattccttggggcaaaatgtggacaaggaatcttatggcaagggccttatatgacaatgtcccagagtgtgccgaggaactggcctttcgcaagggagacatcctgaccgtcatagagcagaacacagggggactggaaggatggtggctgtgctcattacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggacgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagttgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagaccatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttaacattttatgggtcagtcaactttcagaaattcagggagctggagagggaaatctttttttttccccctgagtggttcttatgtatacatagaagtatctgagacataaactgtacagaaaacttgtccacgtgcttttgtatgcccatgtattcatgtttgtttgtagatgtttgtctgatgcatttcattaaaaaaaaaaccatgaattacgaagcacctt

SEQ ID NO: 19816 - DNA, 2187 bp, Homo sapiens
gtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggcgagactcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcaga

SEQ ID NO: 19817 - DNA, 1494 bp, Homo sapiens
gcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacactcaactccgcccctacccaaggaccgacagcggctcccggagcctgccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcaga

SEQ ID NO: 19818 - DNA, 810 bp, Homo sapiens
ggagggttgggggctgtctgggtgcgggtccactggacacacccgggcctggagctggatgccggggatcccagagacgagcccggggtttaggtgcgcgacgggctcgcctgaccgtggccggccctgcaccgtggggcgcccgcctgactggagcaacggtcagctggggggcccggggagcgtcggggcctggggcgggctctggaccgaaacagactgcgtggaagggcgagccttccggtgaagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaaccca

SEQ ID NO: 19819 - DNA, 1517 bp, Homo sapiens
gcctcagagaataaataggagactaagaggacaggcagacaaacaggacgagcctgggggctccaggcctggacggaggaagaagccagctatacggggtttctccatgctggccaagctggtctccaactcctgacctcgtgatccgcctgccttggcctcccaaagtgctggaatttacaggcgtgagccaccacgcccggcctggtcattctttctctccacaatccaatgaggaaactcatctgcccacccaactaccatcataaagtcctcaggtgatttctcaagctatacctccattgggacatctctctccaacctgagaccactggatatcacccacaatgctatatagcacctcaaactcagcatatctatgatgggtgtctgctcagcatccactcgccttttctggtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacatgactagcacgctgagctctgcagggaccagtgccaggcactggggggtggaagtgtggtgacacagtgaatgggaggtggaggagggttgcagctcccacctcagtttagtttttaattcagg

SEQ ID NO: 19820 - DNA, 1976 bp, Homo sapiens
gagctgagcagaggcaccaggccctgctccatggagccttcagtctcctgggaagctgtgcctgtctggctctggcactgaccacatcctctcggccatttctgaagtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtccaggcagaattctaatgcaataagctaaatgttcttgcaatttaagaagtgttcattcttta

SEQ ID NO: 19821 - DNA, 737 bp, Homo sapiens
gggggtgtgtacgccatgagggggaggaagccgagaagcacctcccactgaagccggcggtaaccgccccacgcgagaccacccaccagccaggagcggtcgcaggacccgcagcggcgcgaggccttgtttacaccgactgccgccactgcgttggccaaccgctcctccgtcacgcgcttcgctcgtcacgcatctcgcggcttcctggccggcgggctgcaaacgtcacacgacggccccgcccccttggccagccaactggacagcggagcacgatgattgataggccaataagatatgcaaatgatctccttaccttattggttggaggcctcaggaccacagatgacctcagagagctggccctttaagaatgccctttgggctctgtgcccacagccccctggagctgagcagaggcaccaggccctgctccatggagccttcagtctcctgggaagctgtgcctgtctggctctggcactgaccacatcctctcggccatttctgaagtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacc

SEQ ID NO: 19822 - DNA, 788 bp, Homo sapiens
ccaaatcctgtgagggtcaccgggttgcaggcttcaggacagggaaacgcagcgcgttggagggttgggggctgtctgggtgcgggtccactggacacacccgggcctggagctggatgccggggatcccagagacgagcccggggtttaggtgcgcgacgggctcgcctgaccgtggccggccctgcaccgtggggcgcccgcctgactggagcaacgctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacat

SEQ ID NO: 19823 - DNA, 2103 bp, Homo sapiens
cgccgggggtgtgtacgccatgagggggaggaagccgagaagcacctcccactgaagccggcggtaaccgccccacgcgagaccacccaccagccaggagcggtcgcaggacccgcagcggcgcgaggccttgtttacaccgactgccgccactgcgttggccaaccgctcctccgtcacgcgcttcgctcgtcacgcatctcgcggcttcctggccggcgggctgcaaacgtcacacgacggccccgcccccttggccagccaactggacagcggagcacgatgattgataggtgcactcctcccagcccagctccagaatggccctgccccccagccccctggccatggaatatgtcaatgactttgacttgatgaagtttgaggtaaagcgggaaccctctgagggccgacctggcccccctacagcctcactgggctccacaccttacagctcagtgcctccttcacccaccttcagtgaaccaggcatggtgggggcaaccgagggcacccggccaggcctggaggagctgtactggctggctaccctgcagcagcagctgggggctggggaggcattggggctgagtcctgaagaggccatggagctgctgcagggtcagggcccagtccctgttgatgggccccatggctactacccagggagcccagaggagacaggagcccagcacgtccagctggcagagcggttttccgacgcggcgctggtctcgatgtctgtgcgggagctaaaccggcagctgcggggctgcgggcgcgacgaggcgctgcggctgaagcagaggcgccgcacgctgaagaaccgcggctacgcgcaggcctgtcgctccaagcggctgcagcagcggcgcgggctggaggccgagcgcgcccgcctggccgcccagctggacgcgctgcgggccgaggtggcccgcctggcccgggagcgcgatctctacaaggctcgctgtgaccggctaacctcgagcggccccgggtccggggacccctcccacctcttcctctgagccgttcagagcaccttgtggtgtagtgggggctgggtggggtggctccgcccaggaggcggctgcacggttctctgcatcgttaccagagcgccttctggtcctagccacgccctgtatgaccgcgcaaatatccccaaagcttttgggtcctcaagtcatgcccgaatttagatgctggtcattttctggagaggggtcccctccccttacgaacacagaaacccagcccacatgactagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattagcaatgaggctgtattttcattctgaagcttgtaacctccccattttagcactacagaattttcaagatttcaatatccaacaactagatagattaggacctctatccgagatgctttttccctgcccaaccctgtggccttcagggctcagagcagcaaaggcctgaagagtgagctctgggggttgttggtgtgggttgggagagagctgtgtgcagaagtctggaaacctgggtcctagtcccagctcttccatgggatccccctgtcaccctgagcaaatcagttgcttcctggacttgtgttacttcatctaattctcatgtggattggacgacttctgctccctttccagttctggcatctccccagtatggaagtcccggtggtctccccaagaagtccccaagacaatctcgccaaaggcacctcctatcctgctgcagtttcccagctgcagcctaggcaggggatgcacagcccaggcgaggaagcctggcttctctgtgagcacatacgtgggtcctcggcagctccctccaggctgtctgggcctccagacctgcacagggtgctcctgccacctcccacctctctgagggctgaggtgagacttctcctgggatgacaatttgctgagagagtgcagcttttgtgaattaaacttgaagtcca

SEQ ID NO: 19824 - DNA, 3854 bp, Homo sapiens
atggggggacagatcacccggagcactctccacgactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctga
